United States Patent 6,972,197 (PLANT CHROMOSOME COMPOSITIONS AND METHODS) - sequence listing, part 2

SEQ ID NO: 209 - DNA, 611587 bp, Arabidopsis thaliana
gaacccttgagaggtgcaaaatcataacagtttcaattatatattgtgtgggttaaatggattttcaaacaatatctaacagattagattcgaatatgaaacttttttagaaacctccctgacgctattatcgagaacgctatattccatctcctctccgacgccggtggagctgaagctcgccggcgtcagaatctctctctcatttctcaagttgtttcctttatcttcaagctaaattttcgcttcgatttaattttcctcttttgcaatccctttaatccaaacctatcgaacctttctctactgttgaatcccctctttgcagcagtgcgttccgacatagttagacagtggcctctgagccatctacactctctgccaacactttgcgaatcaaagacaacagtgactgaatctttcgactccacttgcgttcaacttttctattttgagatttgtctccatcgccatatcgtccctagatccacgggccctctttgctcccaaggttttctccatcgatctgttgcaaaactttcagccgtggtttcatcctccgcgtcggatccgccatacagttttctcaccctgactcttgctttatcgaagatgtctgctccaacgacgcggtccgtacccctccaccgtagccgccgcgcctccaacgcttcttgcccagcaatctggtttctagggtttgcctttatgggccctataaccattgttggcccatttcccctgcggcccaagcccatattttgcgacccaagtcctttaccaattaagcccaggtttgtttctttctgcaatttgcagagtctgtcccaatgtaggcgtcgtttctctgttttgagtggccatggacaccatttgaatggcgaatcaccctcattgctatgctcctgcaaacagtctctaagaaccttggtgctaggtttatgtagggctatgctttatgtttgctttttgaagtctcttggtctagttttgatgcgtccaatctgtcggagatgtgacgctggtcaccaaagccctctatcaaagtacttcatgccgacatctatatcgaccaacttcaagaacatcccaaccatctttccttcccgagtttggatcaagcttcccgactacaagctttgtgtggaattccttaatctccttggccgctatggacttcttgtgagagaggacccacctgttttgttacggtatcgcatcaatctatctacgcctcgacgatcattctctctctaccaaaaccttgtccgaacctttgccaaagctctacttagtgtagtacttctcgtcccgacgagactcttgtctttggcgcccttgttaacgttactacgtcttgtgacagtaaccactttctctctcgctgctttgttcgtggaagtattgtcaacaatcctcgaccttacaagtaccaaattgcctccgtgtgtttggttcatagctctcttggaatttttgttgatatattttatttgtgtgtttgcttttcttcttatggtattggcgaatgcctacttttgttatcttttaaactttgggatcttagaatcctctttccattgtacttgtttctatcttagttgtatgaaaacaagcatttgtccaaaaaaaaaacaaagattcgattatgaatcccttaaaaggtaaacttaaacaatcattatgatcttgagaaaaaaagcaattgattgctaaagattttaaattataaaataatcacttagaaacaagaccaatcatgataatcttgaaaacaaacaaaaaattaatatacctctgtcaaagtatcattcataggtcatattcaattttcgaaaatttcaaatttgatatagctcaaattatccttaagcttattccctcaaataagagatcgtcgttagcactgaatgatcgaatttcactaagctctcgttgttcacacaataaacttatgatgattaatattaagctagacaaagtagatgaaagtaaaagacaagaaaacagtaaatcgagttgtgagttcaggagattaaagcgtgaggtctagggatagtcttaggaaatagataaattgtagatcttgctatgactaggattgttatcaaactgttcttaaactcaaacactattacagagtaacttgtggttcgctatattactcattatgtccaaggctaaagattccttgtgttggcttggcaaatccctaatttaagacatgcatgctaacgagttttataacttcaacttagtaaacatgtcgattcttattacacacctataaacccggctcatctataatagttctgatgacagatacttttttgggcatacctattatctaagatcaaattctaggtgatcaatctagaactagcagtaagaacaattatagatgaagaactctaaaaataatcctaacaggttatcgatttactaatcaatctaaatccctagtgagacaccctaaacccaacaaagtgactacttagacatgatcaaagaatcacaaatcttgatttgaataaattgcattgaattataatatgaaatagagtaaaaggatttcagaatgttctctaaatggatatgattcttctctccaaaagtatgtctcttacacaaaactttcttaggtctaaacaatgaccttaaatatatatatatatatatatatatatatatatacgttactaaaaacgtgcatggtctattttgcaaataagaaaaacttatgggacttctttaagacttggtaaaacgtggggattttctttgtcgaataaggttgtcgatcgacaccatcgcatgaataacgtttttgctggtcttctttgctgaaaagcttccaaagttccttattatgctccatagctctcaaaagtatatatgcacctctaatgactacaaaacatacgaaaatcactagaaagactctcaaaactatcccaaaactatgttagaaatcagtaaaaacccatgatatatcaactctctcagacttagcttttgcttgccctcaagcgaaacaataaacttaacctgtgggaggggtttgaaaacgtagaaactcctgatctttctagcatattaccttgatcattcaaaccaaatccatgcacttaacagttctaatcaagtcctaaccaccatgtaattctctgcacgcttacacaacatcctaaatttcataccaaattccacaattatatctattaggctttcgtcgctgggtctcatcaatcaagttaggattcaagaaccttctacacgcattcatgtactaaacacattttcaatagttttaaaattgatgtatcaatagttttaatagttttaatgatatatcaacagttttaaaattgttagagatataaacacattttcaaaacaaataccagtggcataacgcagacttttacctaatctctttttaaaagaactgtttattttggcataagtaagaaaagtagggatgtttcacatattcgattgtaagtgtgaagattctcaatctttacaattttgacaatatgaaggatggcaaaaaaaaaacatgattctcgtggatacaatggttatttgttttttttggttttgttttatattatctttttctgtattttacaacttcaacaagtttagagatattaaagaaggtgaatggtagttcataaaatattttctggtcatcactctccaagctttagaacatataattataactcatttaatattaagtttgctcatcttaccaaatggcaaaaactgatgaaaagttggctttagtttttctgctttggaaaattttaaaaatgcaaacgggaaatgtaaatcagattcgtgcttttggtaggtttcttttcttttatatgatatagttaattctttgtttttatttagatttgaattttataacatttattgtatattaatatagttctaatatgggtcagttaaatatatatacttctacggggatttatttaaggatgtgtacatgtaaaaccaaaaattaggtgaaagaaaacatgcaaaataaatatgccagatttggccctatagctaatgatacgcgtagtgtaagctacgagattttcgcatatcccgcatttaatgagacgacaaaaactgcaagaaaatacgccgccgagacttaaagagagagagaattgtaatgatgatgagagatataattcagtttgcgtgtttgtgtatttattacgcccctatctatgttgcttcaccaaaagaactgtaaacacctaacttcaaatatctgcatttactaaggcgacgataacaagatcagagtaattgaaggctcaggtacgaatttaattctcaagttactttgttcatcatgtgtatatgagtaaaaagtgagcgctaagtaagggttttaaaactttgtctcatacgaccgctaactttgcaattatgggtgattatcgacaggtgcaatggcgatggttgttcggctggttcgaggagaatggaaaagagatgagtacgggtgctatgaacacgtagcagaactagatgggttatgcttggcggtaaaactccgggaaagggacacgttcgctaaagttgttaccgtcgtgaaggagagactgtcactcgggtcggaggatgaagtggagttgtcttaccaatggctgcagtggatgatgggaccagatttggcagagggcaaacccaatacctattctcgatgatgaggatatgactttgtttatggcgatccgatctgatctagaggaggttcacctgaaggtgaagatcatacggaaaatgttgggagcatcaaccgtaaattcccaccgaagcgtcttagatatggggaatatgacctcggaaacgatatccgataagtattggaatagcagtgaaacacgagcagcttgggattccgcagtaacgagaatgttgtatggtatcgtctctggtaatagtgtaaccggtgatgtcggtctagccaaatacggtgcaggaccccatatagtcaggggagggggtataactatcagagaaaacacgggagagactggtgttggaagcgtcgcaccaagaacgctaacctaaggccatccaactgcaaccgctaaagggaaagaacgtgtcttggacgaagagagcatcaatgacttggagttcgcagtttggaggaagaaccaacaggaagtgatgctgcgagagatggaggagagagaaatacgactggtaagctctacggtaggacagctcgtcacgactccagctaaagctacggataacgatgttagagggcaaacaagttcaaacccggaggaagccattcgtcttacacttggcaacgcggctccagttgctgacgtggtatccgtagtggctctatcttcaacagactcgacattcaagacaccggctaagagtataagcttctctagtgaggatctaatggacgaagacgaagtatctagtaacaattgtctggcaaggataggtatgttagcaaatacagttagtcttatccaaataacattcatgttgacttgtaactaaccgcaggatctgataaagtttttcttacccatatacaaaggcgaagacgaggtggcgcactactactcagaccccgacggaccgctgtgtatggcaccaatgaacacccccaaaatgagtagagtcaacaacattgttaggggggagattgttgcaactgaggcacaagttaatgagttaaatacccatgttcgccggaggttggcagatattgaaagaaacaccagtgccaacagttttgtatgatagggacgccccaccatatttcgacgaccctggagaagaaggtaacacatgttaggatattatatttattagcatctatatgttagagtatctgataattgtggattaaaatattatcctataagtcaggtatttatccggtaaacattaacatatctctatctctgtaaatttcagattatttgcatcgagctctaaaggacgcagactatgaaggggacaatatcttcatcggaagattgttcaagaacaaagaagattgtgcaacaaaactagctattcatgcgattaggcgaaagtttaacttcattactgccaaatcttgccccaacattgtactcgcggtgtgtgtgagtcatacatgtccgtggcgggtttatgcgaccaaactggaggacagtgagaggttcgagataaagtgtgcaacccagcaacacacctgcagcgtagacgctagaggagatttccacaaacaagcgtctacagcagtgatagggcaactcatgagaacaaagtaccttggtgttggaaaagggccacggtcgaatgagttaagaaagatgttaagggatgagtttagccttaacgtctcgtattggaaggcatggagggcaagggaaatatcaatggataacgcaatggggtcggcgatgggcagttacgctttagtccaaccttatttcaagctccttatggaaacaaaccctaactctcttgttgccatggatacggagaaagataagaaaggactggaacgattcaggtacttgttttttgcactggacgcagctgtaaaaggatatgcttatatgaggaaggtgatagtcattgatggaacgcatctgaggggtagatacgggggctgcttaatagctgcaagcgctcaagatgccaatttccaagtcttccccattgcttttgggatagtgaacagcgagaatgacgatgcgtggacatggttcatggagaggctcacggacgccataccaaatgatccggatttggtgttcgtttcagacaggcactcatcgatatatgcaagcatgcggaaggtaagttatttactgataacggataatattaatattacagcgatatgaatatagttatttttataggaatatataaccccactattatgcagtatttatcaatcgttaacaatagggttaaatgatatataaattttactgttacctgttaactaaggagttatccatacttaaaagtctgtggaatttccctagtcatattgatagtgtgatcttacaggataacttatattttattttgacaacggttgtaaatagtgtcgctaaaataacgcagcagtgttagctgagacgttttctattagttgctaacagaatattcgaacgtcagtttctttatagtttgtgttttatccatggagtatgttttatcaataacactgatacattggctctaatttctaggtttatccgatgtcatcgcacgcggcatgcgtggtgcatctaaaaagaaacattgtctcgatattcaagtcggaagggttgagctttctcgtggctagtgcggcccgatcttaccgtccaagcgacttcaatcgcatcttcgccgaggtaagggctatgcacccagcttgtgctgattacctcgaaggcattggttttgagcattggacgcggtcgcattttgtgggagataggtattttttcatgacaagcaacatagctgagtcgctaaacaatgtcttaaccatggcaagggattatccggtaatttctctcttagagaccctgcgaaccacactggttacgtggtttgccctacggcaagaaactgcacaacacgagggaaatcttttgctccccaaggtcaatgagatggtcattgaaaattttgaaaaagaggcagggtttgttgtgcttaaaataggagatgcattttaggaggtgcgagacaaggaagattcggcgttcgcggttaatctttgggaaaggtcatgcacatgcagggaattccagctgctaactattccttgttcccatgccatagcagcgacaataaaagaagggatccgtgtcgaaacaatggtcggcgtccaccacaccatcccatatctgaaattagcgtacaaggggatgatcatgcccgtcccggacatggatacactggcaccttccctagtgatgtcggaagcggaaagcttgcgccaccttacgttcgtaggccaccgggaaggccgcgtaagaggagactattctctaggggagagtttaaggtaacattgttagtaacggatatataaacagatagatatatcgctaatgtgtgtgttatttatctgcagaaaaaatcctcaaagcgttgctccagatgcaggacagtgggacataatagggcaacgtgcaagggaccggtttcggtaacaatcattttactatttattattacagaattaacggtaacattagagttaccaactcatgcatttacgtgcaggatccataactgcgagcgtggggttgttttttgggggaaggaaaatgttttttgaaaaagaggaggtttgaaaggatggtgccatgaaagttggaaactaagaatgtgtgataaataatgcagaaggatcaggagattttccctgtatatacatacggaatttgatccttagaatgtaatattactatcgggggcgatccccatcaaacctcctctatgcatgtgatatattatgataaactttctgttaactgctataatgttgtttggtacttttgatgacgatgttcaagcatgtatcaatataaaatatttaaaactgtgttagagaatatagaacaactgtgttaggttttatggaaaatggaaaactatattgttaacgataatgtttacggagacagctatgaataaaattttaaaacgataacacatctacaatatcagttaataggtgggatagctgatatggaacattttaaaattgttataatgagttaactaaagtaaaactaatattaacggcaacaaaaaaaagttacaagttaccgataaattctcaaaattaataagactctgaatgaacgaaagtcaaagaatgatacacaataagttacaagttatctggatatgatatgggttaataaggacagtttaaaacgggttaccacacaatgttaatagatgcaaaacgagaataatgtaaccctaaaagggttaaaatttgttatatcagaatgggtagaaataatatattggttaagagatacataaacacttaccccatatttaaattggtaatggataatttatacacaaagatttatatcacaagaagagacccatagtacagcgttggttatgtaaacaatattgggtaagaataatattatcgaatagttaatagtatatggttaacaggtaagtttaaaaactacccactaatatgagaccactaaataagctaacaaataaattagcaactaaataatattcaagttgcgaataatatattggttaagggatacattaatacttaccccatatttaactttgtaatggataatttatacacaaagatttatatcacaagaagagacccattgtacagcgttggttatgtatacaatattgggtaagaataatattatcgaatatttaatagtatatgggttaacaggtaagtttaaaactacccactaatattagaccactaaataagcaaacaaaataattagcaactaaataatattcaactaagtaatgagattaccaactttaaagaatgtataaatctaatgttatcagaaagcgtagaaataatatataggttaagggatacattaacagttacccaaaatttaattttggaatggataatttatagacaaagatttatatcacaagaagagaactattgtacagcgttggttatgtaaacaatattgggtaagaataatattatcgaatagttaaaattatatgggttaacaagaaagtataaaaactacccactaatatgagaccactaaataagctaacaaaaatattagcaaataaataatattcaagttccgtaatgagattaccaactttaaagaatgtataaatctaatgttattagaaagcttagaaataatatatgggttaagagatacattaacacttacccaatatttaattttaaaaagtataatttacacagaaagatttatatcacaagaagagacctattgtacagcgttgtttaaggaaagtttaaaaacgcgtgagctcacaatgatataattttagagatagggtctaataattataacccgtatgtgataactagatgattacgtgctcataccattatccaagtgttcgggttggaaaactaaaacaatgtaaacctataaagccataaacacaacgtcagtttttgaaaaagaatggataattattaagttatgatgtaatccatccggttacattgacaatttcattgctaacatagttagacacaaacagtgtctttagaaatattatttacatagtgaaagtgttataatgttacaccataacccgaataagaacgaatactcgaagttttacgctataacgatgaaacatattgacctaggagataagatatacgttataacagagttaccgttaagtgataatagttagttgataaatatagctaccaaaaagttaccgtccaaagagcagagataggtgataaatatagcgagttatagagtaacaaagctttgaaaacgatagcgaaagcaaatagtcaaagctaaagcaaagccgataaataagttcaaacatgtgtactacacgcaaaaggaagggaggcaatgtctttaaggccaatagtcggctaataaaaatattaggaggcaacacccgacaatattattgtcgagacaagttttttaacttctacatccagcgcaacaacgtcaaactccatgcattcctcgacccctccgacagcatgggcgtggatgaggaaaaccgatagaacaccggaatcgaacggggaggaaacttgcgggataccatgcgggcgatcaagcagaaagggttgcagcgagatgtccccgctagaagagctagtctgtcggaaaaggtaagggagcatggcagccagcggctggagttcggcatataacgctgcatcacgtcgtagctgaatgttggaatcgaggatggtaatcttatgtgcctttaggtccacacacagcgacacccaatgttttttgtcgaagttgaaaggcatatacacacaatcagcctcagcaaacaaacgaacacggttggactcaccagcaccaattagtagatcaactaaagcagatggaaaaatgaaatctttgggcggcaaagttttagcaaacttcggaaagagcctcgtcagctgtgaaacgaatttcgagccaagcacatcaaccctgagcttctcgccatcaatgtcgtctgtccgtaagagatgtctgctgaatttgatcaaaacgtccatgactttgctagagaagtgtttcttccgctcaatgatgtcgaaaatctctttgtgggaaagagaagcttcaccaacaatgctaatcgagctgcaaaatcaattgagagaagttataattctagtgtaatatgataaattagttaaccggtaattgcattacctttttccctttatcttcgagagagatcgttggtaacgcacttctggatcagatgccaactccccgacgcttagaaatggggatgggtgacccaccagtaacttagttttcttgtcgaagtgaaaccgcccatctaacttactagaaagcgtccttggtcttttgctcttccttccttgattgacatcgccatcgggaccgccgccatctttcccagccaatagtttaccgccggaaggcggaggggggttgaaaaatcctaatgaaaagataaagcaaaataaggagtggggggggggggaaagaaaaaaattaaaaaggaggaaacttcggattacctcatctgaatcctgataagggttgccaatcgtcatcagatttaagagagatacagtgtgagtagataataaagtttatagtggataacattaaagttagtaacgttggacaatagttaccggcagattaggaatcaaagaagctcctacggaagaaacattatcaacctgtattaaaaaaaattacacaacggtcttagatattttacacggtaaggatctccttacccggaatttgtactattagctaataatgatgttaaatatcaagtctaacataaaaaagtgcctaccttcggggtgtcattgagtttagttatcggagatgaagccgtctaggaaaaaaggaaactaaattagcatcaataggtacaatcaatttaaagtaaaacgccataatagtgattttagtatgtaacactgaaattagcttcataagtaaaaatgggtggggtggggaaaaaatcataacctttaatgcctgggtcgggagagcgctgggatgggttggttgagatgaaccaatctgtgaagagaacatcgcaaaatcctgggattcctaaaaaaataccgtatacatacacaattggtggataaggaagaatttatcaattaaatataagatatttaaaaatcctccatctacctcaggagggttgggtgcaacaactgatgtagcgacaacaacgacagatggtaggggatccaacggagcgacggggtttaatggatcaggggcaacatcgggtccgagagcagtattctgaattgaatacaaacacgacacaataactggtgatgaattataaatatttaaaaacataagtctggatacaattagcattagcaaactaacctctgttgtaacagacttcggagggctaactgtggaggaactggggtgggccacaccatcagacggcatgttgacatcctggacaaaatatacattagtgaacagccatgcgtaatgtcgaaaaaaggtcataaaaagaaataaaattgttatcggatacctattgtattatacgacaacagcttagttacaaacaatgtaatcgaacttagggaataactatatagtgcacgacaagcatgtacttgttcagccattgccgcattaatatcatcgaccatctcaacgtcggcctacaaagccaaaacatgttaaaaacgttaagtagttaataacttaattaccagatacatttataattgccgcggtctacaggttatagtgtaacaattatatcgaaaatggaattaaataaacaaattgttaacggataaaaagtttattttacgttaatagaattattacaattgttctaagcgacttagtgactaactttaaagtacaaaaaaagcatttacctggtgagccctgcctgcgttaagatcatcgaccatatcaacgtcggcctacatagcaacagtaaattgataaaaaagttaataaactataaactaaagtaccagatacataaataattagcgcactataaacgttagtctataacaaatatacctgttggttcccatttttttccggctgaacaccaacttcttcctcgcccgactgatatcgtgaataataagagaaacaggacaatttaaacaacttcgttacctcccctattctcgctaagacaaataataacgaggtaaggtcgttactcgctaacctgcactttgttcgtcttattcgtattggaggcgccgccagacggatcagtcggaacattaaccgagttgtagaaagaaacaacatcatctactgctgatattgcttggtcaccctggaaagatggaagggtaaaatcagtttgcatggatgagggttgcctcggcggagggatggggttaaaatccgactcctcgtattcgttggcagactccggagatgaaacaggattggagttttgctcttctccgccagtttccttgtcagcttgaagaccgttatcccccaacgcaacttccttgtcagtatgaggaccgtgatctccgtctgcggcttctttgtcagcttaagaaccgggttccccagaaggaggacctttcggattatcgggatcaacaaccaaattttcagtaaaccagtgaatcacgcctttgagaatcttctcagattgcgccttcaatttttcatcaatcatacgagacaaagcatcaaaatataccccgctagagctttcgcctttctccccgatgggaccatgattctttctcctcatgccagtggctggtctcgcattggattgggctttcattccacgaactaccttggttttcccacctgtcttttatttttttgacgcaacaactatatcggtcggaatacaaccgccacaaaacatttcattagaaaacgacttgccttcctttgccatcttcaccatgttgtcaaccctttcaccgtcttcatcatctgaccatgttagatcttcaacgggattcaatcgagcattggggaagatgattggttctacatgagcctgcaggaaaattaagtaacgtattatatagcaccgtaatagtatatttataacagtaaaagagttatcgaagaaacaaaattattatgggataaaagagattgaattaaaaaaacccatccatctatccaattaatagtagggtccttaacagtatcgttagcatgtaaaacaaagagtttgatagacaataatgatggtaacgttatcatggtaacagagttattttcaatgaaaaattactagttgataacgaaaaaattggagtaaagaaatcaagaaattcgccacttaagacactaacaaagaagttaatgtgtatcaaacatgttatcgtatatgtatcattagcacgtaaacaaaaagtttgatagacaacaataatggtaacattatcatggtaacagagttattttcgaagaaaatttactagttgataactaaaaaattggagtaaagaaatcaagaaattcgccacttaagacactaacaaagaagttaatgtgtaacaaacatcttatcgtatatgtattgggagaaaacattacctcgcaattagaatcgacattttttgcattcccaagcttgagggcaacgcctggccgagtagccacatcagcggctgcttccgcatcagaatcagacaaaacaacctcatcaatttgtggaccctcctgtatggctgggactgcttccaaaacaacaagctgcaaagcgtatagaagaccttgtaccgcaacacacgttgtggcgagctgttcaacttccctctcttttattgaggtcatcatcatctcgaaagacaatcgaccccaagggtaagacaaaaaaccctgcagatcctcggacatttccgcgtgatctttaattattttagggtaatgcgatgtgggcaacaaaaacccatcaacaagagccaaacaagcataacgcagccttatttcgcgatcggtaacaacccttttcttaagcatcgcaataaccctttcaactgtgacatcttcttctagaccgaacagggtactgtaataggggatttgcttcccccgtccctctcttcttcttcttctgaactttaggatatttgccacacggaagcccggtaacaatcttaaactcccttaacgaaaatcttaccggagtcccagcgaacactacccaaatctcgtgggggttgaaatttccaattgcctactcagtaataagagtctgaaactcgccgagaacgccggtttattcggaaaatctaaaagcccacccaatgaattgttgaggatgaaggattactcttgttcgtcgatagcgttaataatcccagacagtgtttttattttgtggtacacgtttaccctttcgccaagcggctcctccccaaatgcaatcaaccggttgggtaattcgacagactccatctagaacaaaaaaaaaattgattaaactagaaccgccatgtgaaagaaccctaaccggagccgaattagaattcaaacattaccttagaaatagaaacgcagcgccgaagagtttactccggagaagactaattatcacgggctccgccgaggatgatgtttggatatcggaccaaaaaagatgcaactcaatgagactttaaacgaacgctctcaagagttgtggtgactctcagatttttgggagaataaaaacactagtaaatataagatccattgagacgcgactcttcatttttagcagataaagttcctcgcaagcctttattaaatgaacagtgttcaacaaacaaaatctctcgaaagattacgttgccgtctgacacaatactagtctagcggtaatgttcattttcgaaatgatttataggggtataggggtcattatacacatcaacaatcattgggaacagttgaaaaatggacgacctaattaccgagtcttccatgtacatataatggtaataccattctaataatgtctatgacattagatgtttgtgatgtggtggagttgtaaatgtgtcaaaagttcaacaaatgccatttttttgtctaatagctttgaagtacatcttcgtaactagtttttatttaggaaaagtgactacgagttaccctctcaaaatattacttttatttctatttttagttgttcgattcatagtaataattttccaagtgtccaatattctactataattaatttttgatattttgagtttgtttggctacgaaacaaagaattgacttgagtaaaaaacaactaaagtgatgtgtcgaatttcagaatttaataatataaaattttggtcaacgcggtttatccttcttcgaggatcgttttattggtccctcgaacaaaataaataatagagacgattttaagtggataacactctaaatttttgggggattgacatgaatgacactaaaaaattttattattttaaaaataataatttcttttcaaacttccaaaaatagcatataaaatttttaattctctataaatttattaaataataaagtttttttattaccatttgtatcaatctcccaaataaaaatgcgagcaaacactaatctaatattaaattgaatcaaaaacttttaaatagtaaaaatatataccctaaattagaaataaaaaatgtaatattacaaacaaattttaaaataaaaaatctcttttaaatggtgaaaatatataccttaaattttttttggtagaaaaatatataccttaaattggaaataggaaactcaaatataataccataaactaatattaaaagaaaaattctttctaatgcccttttcatgatgtcctttttcaactctacccttttgttttatccattttcatttctaccctctttaattttttaatgaccattttacccatatttagaaattattttaggttaacaaaatgaaatattaatgttttttcgcctaaaatattccaaaacaatcccgccaaaagtttcccgccaaaattaatttttcaaaaaaagaattctcgcaaaaaacattacaaggaattttaaaaggaagattaacaagtgattttaaaaggtttttaaaagatttacaagagattttaaaagggttataaaagatttacaagggattttaaaatggttttaaaagatttacaagggattttaaaagtgttttgaaagatttaaaagagattttaaaagagttttaaaagatttacaagatttttttaaagggtttaattggagtttaaaggatgtacaaggattttaaaaagatttttgaaaaattaacaaaagaccctttaaaaactcttgtaaatctttttaaaaccttttaaaatcccttgtaagtcttttaaaactattttaaaatcccttgtaaatcttttataacccttttaaaatcccttgtaaatctatttcccgccaaaaaaaatttacaagaatttttaacagcattgttttggctgaaaaaaaaattgttacgaaaaaaaatttggcggaattttttttttggcgtgaaaaataaattttgtcgccaaaaatttggcgaaaaattttcagtttccaattacatgttccaattagatgagggtaatttggtcattttgttcaagagaagagatatttttaaaaatgaacaacataaaagggtattgttggaaaagggtagtaaaaaaagggtagttttgcaaatctcccatattaaaatgaatcaaaatttattttaaatagttaaaatgtataccctaaattagaaatagataacccaaatataatatttttaatttatttctaatttattttggttgaatagattttatataaaactgtggtattattatgaataattcactctaatgcccttttctcaatgcccttttgcaactctaccctttttttcccattttcatttctaccctttctaatacttttctccccaaattacccttaatgagctacccacagacctaattcatttcttcactctctctcttcttcctccatcggaaattgtgaatgtcgttgaatcccatgccgtcggaaatagtgagtttactcgccgtgaaaacccatcttcgccgtcgtaagtagagctgtgtgtcgtcgtcgaatctcttgcgtttcccaggtttgattttataatgttagcttaaatcttcgttttcgaattggtttattcgatttttgttgttgattatgtgaattcgttattttaaattctgattcaatcgacagtttgacatttgcttcagcttcgaatttgaattttgtttgagatttgatgattgaatttgtttctaaaatccttgtaaattcgttatactgttctaaaatccttttgaattcgttagactgtttcgtgatagatttgcttatgtgaattcgttatactatttcgtaatagattttggttctgatttagtgtttacctcttttgcatatgctttcgtgatagatctatgccacttacgctttaaaacgatttgtaaaccatgttaactacttttcaaagcttttaaaatcccttgtaaattattttatgctacttacttacgctttaaaacgatttgtaaaccatgttaaccacttttcaaagcttttaaaatcccttgtaaattattctatgttacttacttacgctttaaaccgatttgtaaaccatgttaaccacttttcaaagcttttaaaatcccttgtaaattattctatgctacttacttacgctttaaaacgatttgtaaaccatgttaaccacttttcaaagcttttaaaatcccttgtaaattattctatgctacttacttacgctttaaaacgatttgtaaaccatgttaaccacttttcaaagcttttaaaatcccttgtaaattgttctatgctacttacttacgctttaaaacgatttgtaaaccatgttaaccacttttcaaagcttttaaaatctcttgtaaattattctatgctacttacttacgctttaaaacgatttgtaaaccttgcttttctctgtagtgacagtgtttttgtgggtgttgattttgttgttaattatcttatcaggttataatgctagaattgtattctgtttgtggcttgtggaagttgacaaacaatatgacttgggaatttgaattagacattgaattgggagcttctttagtgctcattgatgagcacattacctatcacgcgttggttgatattcttgtagaggattttcaaatagatagttcaaccaattctttgaagcttagttacaagttagtctccacgtctacaaccatacaatctcatcctctttattttaggaacgatagacagcttgcaacttttatgcacaaattctcacagagtggaggattgcttcagttatgtttgactgtagagcaaatttctgtgacagttgagcaggtttttcaataaccttcttgtgtaataattttaaaaatccttgtaaaatcattattaagtcagtgattgtgcttattacaggctgagactacttcaaatccttttgtttctcattttgtccctactgctcaggtactaatcgttttaaaaatccttgtaaaatcattattaacgtttttaaaccccttttaaaaatccttgtaaaatcattattaacgtttttaaaccccttttaaaaatccttgtaaaatcattattaagtcagtgattgtgtttattacaggctgagacgacttcaaatccttttgcttctcattctgcatttactactcaggtaataatcccttttaaaaatcattattaacgtttttaaaccccttttaaaaatccttgtaaaatcattattaagtcagtgattgtgtttattacaggctgagacgacttcaaatccttttgcttctcattctgcatctactactcaggtaataatcccttgtaaaatcattattaacgtttttaaaccccttttaaaaatccttgtaaaatcattatttaagatagattgatgtttgaggtaaactttttattttggcagccgaggttaacctctaggattattgaggtctgtgtatctgaaacatctagtattcttgatcaacagtattctagttctgcgttttcaactggtctaagtgatgctgattctttgtttattggaaaaattttcaaagacaaagataaaatggtattcacgttgcggatgtttgcagtgaagcacaactttgagtttcatacagtgaaatcagatctcacgaggtatgttcttcattgtattgatgaaaactgtatttggagactacgtgcaactagggctggtggatccgagaggtatgttattcggaagtatgttagtcatcactgttgtgactcttattaaggaatgttagtcatcgtcaagcatctgcaaggacattaggaagattgataagtaaccattttgaaggaggaaagcttcccctcagacctaaatagctgatagaaatatttagaaaagatcatggagttggaatcaattattcgaaggcttggagagttcaagaacatgcagcagaacttgcgaggtgtttacctgatgatagttttgaggttttaccgaggtggttccacagggtacaagtgacgaatccaggttctatcacttttttcaaaaaagattctgctaataagtttaagtatgcgtttctggcttttggtgcatcaattagaggttataagttgatgagaaaagtcatatctattgatggtgcccatctgacatcaaagtttaaagggactttgcttggtgcctcagctcaggatgggaattttaatttgtatcctattgcttttgcaatagttgactctgaaaatgacgcgtcatgggactggtttttgaagtgtttgctgaatataatccctgatgagaatgatttagtttttgtgtctgaccgagctgcttctattgcaagcggactttcagggaattatccacttgctcatcatggactttgcacttttcatttgcaaaaaaacttggaaacccatttcagaggttcttcacttattccagtttactatgcggtttctagagtttacacgaagacagaatttgattctttgttctgggaaatcactaatagtgataaaaagttagcacaatatctttgggaggtagacgttaggaaatggtctcgagcttattctccttcaaatcggtataacatcatgacatctaatctagctgaatctgttaatgccttgttgaaacagaaccgcgagtatccgattgtttgcctatttgagtcaatcagatctattatgacatggtggtttaatgagcgacgtgaagagagtagtcaacatccgtctgctgttactagaaatgtagggaagaaattgaaagcgtcatatgatacttcaacacgatggcttgaggtttgtcaagttaatcaagaagagtttgaggtaaaaggagataccaaaacgcatttggttaatctggacaaaaggacttgcacatgctgtatgtttgatattgataaatttccttgcgcacatggaattacttctgctaaacatatcaatctgaacgaaaacatgtttgttgatgagtttcattctacttacaggttttatctttattcttcacaactttacaagcgtttttaaatgttttaatatctctttttatggttttatctgtgtttatgtggttttaatctcagtttacatcgctgtaatttataggtggcgtcaagcatattcagagagcattcacccaaatggtgatatggaatattgggagattccagaaactattagtgaagttatttgtctaccaccttctactcgtgtacctagtggcagacggaagaaaaagaggataccttctgtttgggagcatggaaggtctcagccaaaaccaaaattacacaaatgcagtaggtgtggtcagtcgggtcacaacaaatcaacttgtgttgctgcaatttagatatatctttatctccagagaattgaatattgttggggtttttaatattttcttcattgtgtcgtgttattactctcgtttgttaaaattactatcaaacttttacaagtaattttgaaggttattccaatattttaccttttaaaatctcttgtaaaatcctatttaaaatgtctgtttaaatccttttaaaataccttgtaaatctttcgttatgccacttacatatactttaaacgattgtaaatcaagttaaacacttttacaagcttttaacttgaatcttttaaaatgtcttgtaagtcgtttactaaaattactatcaaactttacaagtaattttaatagtaattccaataatttacctttttaaatattttgtaaaagcctgtttaaaacgtctttgaaaatccttttaaaataccttgtaaatattttgttatgccacttacatatacttttaacaattgtgaatcaagttaaacacttttacaagcttttaaaatcccttataaatcattttctgacattaacttattcttcttaaaacgattgttaatcaagtaaaccccttttaaaagcttttaaaatcccttgtaaatcatgctttaccactttactatccttaaaaaccgatagcaaaccatgtaaactcttgttaattcgtttgcaaggctttacaaatcctttaaaatgtcatataaatctttcgttatgcatataagctgtttatgcctttaaaatcacttgtaaatcatgataattcttataaaaccataagcagttgaaaatagtaaagcattttgattagatttgacagtcataattaaaatacaagtacaatcatagattccaaataacaaaagtaaaataaacatgtttgaaataagtcagtctaaagaactaaatccatttttgccttagtagctctgtctttctctacctgcaaataaaatttaagctgtaagttattttttgcataacaataatattcaagtttttaaagatatatcgttatacaaaggaagagtttaacactaacaattattatcttgtagatttgttcagctaggtatttcacttctggatgagctcgaggcagtttgtcacgatgaatgagtaacgttgctttctttaatgctaatttgtatttcttctcgtcctacatttcccaaatttcgactttttgccatttactgtcgggccaaagaatctgaaatgtaaaaattccaaaatgataagaattaaaaccttttgcagcaaaacaatgatgtaatttaacttacttcttcaagtgacgatagtagatctcttattaatttgtttttcgcccattttttaacttttaggtcaatttcttccattacttcctgactcaacatgaccggcgtcaaaggagtttgaactgatacaaaaacaaaaaaaatatatttagaagttgtttatcaaggcaatcatctgtgaatgtaaaaagaacttacgactgctctgtccctgggtgatttcttcttcttgcgtagagagtggtgtttgattaacatcttcatcatctttcttggtctcttttggaacctgtaaacaaaaacatccaaacaaatttttattttttgacaattttatcatgccttttaaaacaactaaggaatgcagacctttgttgtttcttctttttgaggttgtgattctttctctgtgggtgcagtcccattaccttcatcatctgacaaaattacatatgcttcttgatcttcagtctcatcatattcatcatgttcttctacgttttcttcttttggaacctgtaaaccaaaacatcaaaacaaatttttattttttgacaattttatcatgtctttttaaacaattaaggaatgcagacctctgttgtttcttctttttgaggttgtgattctttctctgtgggtgcagtcccattatcttcatcatctgacaaaattacatatgcttcttgatcttcagtctcatcatgttcatcatgttcttctacgttttcttcttttggaacctgtaaaccaaaacatcaaaacaaaatttttattttttgacaattttatcatgtctttttaaaaagttaaggaaagcagacatttgtttcttctttttttttgttgtgattctttctctgtgggtgcagtatcattatcttcatcatctgacaaatttatatacgcttcttgatctgcagcatcattatattcatcatgttcttctactttttcttcttttccttcttctctttccatttcttcatcgccttgtttgggattctcttgtttttctgtttcttcaacattgcaagtagaatgatgatctctgtattcaacctgtataaataattacaagttcccaaatacaagccaggacacagttattagtcatgtaaatcacttttaaaaagcttttaaaatccgttgtaaaatcttatcgaacactgcctatcctttaaaaacgaatttcaatcttttaaaaccccattaagaagtctttaaaatcccttgtaaatacatatctaacactgcctatcttttaaaaacggctaaaaatctttcaaacacgatttattcaccttccttaggttttaaaaacaatcgatcttcgagatcaccaagggtataggattctttactagcccaaaagtatggttcttttacaggatctttcccctttcgtcgaagttccctatgaacaggttcacattgaattcctgtatgaacaaaagacagtgtcgagactattattacaggttttatagtaaatactttaaaaacgattgtaaatcatgtttaacacttttaaaagcttttaaaatcccttataaatcattcaatgccacttacttatgctttaaaaacgattgtaaaccatgcagacacttttaaaatcccttgtaaatcattatatgacacttacttatgctttaaaaacgattgtaaatcatgtttaacccttctaaaagcttttaaaatcccttgtaaatcattctattcaacttacttatgcttaaaaaatgattgtaaatcatgtttaacccttagaaaaggttttaaaatctcttgtaaatattctatgccacttacttatgttttaaaatcgattgtaaactatgcaaacacttctaaaatcccttgtaaatcgttttacgacacttacttatgcttttaaaatcccttgtaaacgtgtttaacacttctttaagcttttaaaatcccttgtaaattattctatgctagttacttatgcctaaaaacggttgtaaaccatgcataccctttttaaaatcccttgtaaatcattatctgccactaacttatgcttcttaaacgattgttaatgaagtaaaccccttttaaaagcttttaaaatctcttgtaaattatctgtgacacttatgttttaaaaacgattgtaaactacgcaaacagttatgcaaatgccttgcaaatgccttgtaaatcattctacgacagttaattaagctttaaaaacgattgtaaaactttattacctgttgtgagatagaactctctcaaggagaaacggataggttgagaatcaactctaaaccaaagagttgatccttttgtttttactctctgcttcatgagatagtgaaagattttccagaaaatctgattcccttcttagccttcatttttggtcccaattcaactagaggaccaagaaacactcgcctaaagcttcctctactttactaactaaattccaatccgagtattgttgaacggttcccagtgtaatagattcttcaccttctctgtatatctgttcaggcaatgtaaggatttcactctctgaatccatctgcaaaacatgttatgaaacatcgtcagatctactataaaatcgactataaaatcgattataaaaacggttaccgtcggatctatcgatatctctggggattgtttgcgtcgtagagaaatgatctgaatccttcagcgaagaacaagtttatcggagaggaaattcgtcggcgattttggggtttctcagagagaaatttcgtcggcgattttcagtgaaatcggagaggaaattcgttggcgattttgagtgaaatcggagaggaaattcgccggcgattttgagtgaaatcggagaggaaattcgccggccaaaacgaagaagtttgtgccaaaacgaagaagtttgtgccaaaacgaagaagtttgtgaaacgaatgtgaaacctaatcattcagtaagagtaagacagtcatttgccatattagaaggggtagttttaaaaatggccttcaggaaagggcatttttacaaaaggttattagaataagggcagttttgcaaatatccctattattattgtccataaaacttgtttaatcttacttttaggaatttctcaaataattatttgagtgctatttatgtctaaaaaactttttaatgctatttttgtccaaaaaacttaaaagtgtgctatttgtgggaatttctctaaactttaacatatttttattagtaatataaatttctaaattaattttattaatattttaaatctctaaataaaaattttctgtttatgtggtcttaaaaataacggaacattaacttccgttaacaaaaaccaaaattaactgaaaagtaaaacgaactttttttttttttggaagccctcttgacctagtggttagttaaccagttgttcattaatgcttctacaataagaggtttgagttcgagtcttgctactgcgatttattagcagatttgcagattaatggagacaagtgtgtagaagatctacaacgaagtacaattatagtcgttcgccaagattctacgcagataattgaagatgtccatcaagcgcatggagaaggagaagaatgtgtcgtttgtcatggatctaataagggtcagaaagaattgtccgtggtagaatcgtctatgtaacagttttcaaaatttgtaataaatagtaagtttagacggcaaaaaaaagaacttttttttacgaaatagttttatcttttgacgtaaaatagtatttgtgtatctccttaatcataatatttttacttttgatttagaaaatgatataattttaatttttgatgttaaaaatgatataatttttttttttttaaaatggatgacaaaaaatgatataattttacttttgacgttaaaaaagcgaaaaacaagttttactataaaccttcaaacttattttactaacactcaaacctcaaagtaaattttctgtttggatctttctaaaagataatagagtcatgtcaacagaaaactaaaacgtgtttttttttgtcatccaaaaataaacgagtcattcgtgaagaatattgtttacatatataatataaatcggttgggtacgatcttttcgtgtcaaaatatccgctttaacattagctactaaagattaaagataaagaataccttgtgaactcatcattgtcgctctgtaactcctccaaatacactaagaaagttgttcattcggttggaaaagacaccatctacaccagatttgaacagtctgtaagaacaactacatcttggttgtcggcaccattcatacacttcatcgtacaaagaagagcttccacctctgcatgtagtagtggaaattgatttcctctgagtaaaatgtgttatttttttttctttttaacctcaaaaagtaaatttattttgattgacgaaacaaaaaaactatttaatgtcaaaaagtaaaattaaattatttttaatgttgaattatttcattaaaaaaaatacgtttaaattttttgtcgacgggagttatggttcggttatcttttaggacaaaactaatagaaaacttaatttgaaggtttaaagtgttaataaaacagtttgtaggtttataatactaataaaaatatcaaggtttaaagtattacctaatatcacttataaggttaaaaaaatggttttctcaagattaaaatttgagcagatatgtgtgatatagttgctgggtttattttagagttaatgttctaaagttatatatatatatatatatatatatatatttttggtaaaagattaagttttataccattttagtttttttaacagaattacaaagattacaaggaacagaataaagcaatatacagaagataaatacaacattactactcaaattgcgatagatcgcttctaaatgcaaaaagataggctgcgaggtgaaacaccgattccgagctcgcgaggcttggaaatttgcgtgattgccacaagaccgaagtattggagtcctcatcttagttgccacgagcaaaactatccgaaacatgtccacaaaatctcgagatagaagcttatagtttctccgagaactaacgcaaaaacgcataggcaagcgcggacttctacactaactcaaagaattagtgatgccacttagacttattcgccgcctctattcaacactcaacaaccttgccaatgcaactagaagctcaaaatcgcaaagagaaccgacaccaacaaaacctgaaactacaaaactctaccttaaagtaaccgtagaaatgtgtcggggacgaagaaaaatggagacagagaaaccatatccatggctgaggaacttgccaccttcttcaacccactaaaggaggagagacactgtccaccaacaaccaacccacaatgcctctaaccgccacgatcaagccgaagaaccaaaaaggttctgagacttgcctccaaaagagactctcgccggtttcaaacacactaccaccgcagctggaggaaaaactaaggtaagagagaccgagaagagaaggtctgcttaccaaggctcccgctgatgtagcaaaagagccaaaaacacgaggaacgacgacaagtgaagaaatccggcgatgcaccaccggtttcacagaaatggaggatggtctcgccgttaagagccacgaccctgctacaaacgccggatcaaaaccaaaaccagaaacggagaaccctatacgcacaacgatagatctgatgcccaactcgccggaggttaagccttaaaccagcgccgtccatgagcgtcgaatttcagagttcaccaggaaagcaagcaatctatcccaaactgagcgtggttgacgcagtttcaccaccaacaagaggcaaagagcaattctcggagaggccaccattggagcaacaaaggctagatggagaaggagacaaacagagagaaagggaaaggagagatggcctctccgacaactagcaaaagagcgtcgttgctggagaagcagaatcaaagctcaatttagggtttcacctgctttatcgccttatttgggagttatatatttgatacccgaaattcacatgtcgtctataaccaatctaaaatacgaaatatttgcatgttaggacactttatttaaaattttaatcatttataacacttcccaaaactggcacactttttgatcttattcccatcttttccgcgtttacaattaccgtaacacccttggcggaagttcagtcgtccaaccgaaaaccaaccctaaccggtcctcatcactttactcttttttaccttatccaccatctcttgaacatacccttctcgattcaaattagtgcgcttctggtaaaagccataatccaccatactcggttattttctttcaattcttccgtggtctcccttcatttctgtcaaaaatggccgaaattaccgaagatcctaacatagttccaccagtcgctaccttaacaggtaaataactttaacctagattcgttttgtcactcttctctgtcgttttcatcttctataactaaacaacgttttaaattgttcaggcaaggctgcttttcttgatcccgttttttgggataatgatttgccaccacggttgtacggaaccatacgttacccagacgctcgacttaatgtatattccaagtttgattatctatgtttcattaagaaacatatggaagggacacatgagccttaatgtaaactctggcacttcctcttacagacccttcggacgatatagttatattagactgggataatgtgtggattcctcgtcaatcccgtctcctagctgatgttcatgctgttgaacaagatcgtgatgtatgattcaattttttttgttttccccattttgtagcttcccactttcttcattcatttctatgtaattgcaggtaactgaggagtctctaatcgaaatggggaacgccagtttgtatgagtaggatgatgaagttagggacaagaaggtgtcctatatgttagagaagattcaatcgggttatgggtttgcaaagtatgaatggcctggtggcgtcatgtctttggaccttattgacattgttaaggttaagaaatctgtaccccccccccccatcccccttcgaagactcgttccaacaagaagaagaagatgaagcctttgttgaattctccaaaaggctcagtcaaacgtagaaggtcaacccatctcaatcctgacttaccaccatctctttcacaagatttggctgctcgtgttgattctcttgaaaataaaattggtgttcttaaagctcaactaaagaaagtcagcgaccgtaatacacttattcagaacaggtttagggactctagattcctacatgctacacgcagagcaaaaccctcaatgttccgcttcaagaaactcgtccgtaactctgcttcagaaacaacctcaagattcatgcatgctagatggagagcaaaacccacctttcttcgagagctctttggaaaggatactggtgaacaagattggactcattttgaacatccgttaggtggtcttgaccgtaactctgaaccacaagtactgaactggactcattttttggttatttccaccctcatgtcaagcactttataggctccttcataacattgctattttcgtttagctgtctagtcgtcttgatgatattcaggtatgttcattgctctcatcactctcttacatgttgcgtgtgttttactaagcatagaatgtcttcatctatgtttttttagatggaagaaacaatagagtccttcaacaccgcactcactgaacaccaatctgaaaatacggacaaagaggtaaaaatactagttactctgtttagtttcattatagtagttcttcctttggaaatcttaaggaacaatcccccaaagttgtatacttttcgatttactttcaatgtttcacaagtacaaatatgtgtctcactccattctctcatatatgacagtctgaagaagttggacttgatgtaccaactgttatttctcaacctcttaaggtagtacatcacatatacattgtctttggtacatcaaactatatatgcaaactgatattgaatattccattctgatttttctctaggtttcacctgatgtggttcctgaagcgtctgaaccccctctatctgctcaagttgtaaatactgaccttcttgatcttatatcctactacttgtttcataactgtatttagttataactccacttccatctttttgcatacaacaggataaacctcaagaattcccttctgtggatatcaatatcgtaagttgtaaatgagtctttgctaaacattgtatccaagcttgagagttaattatttaatacaacattgtatccaggcggtttggtctattttacattcatgttagagatgttcattaatattactatttttaaatttattgacttttccagggtcttttgaatgatgggacattaaaccgagagattgaatttcctgaggtaccatttaagaaaataaatgattgagtaatcatcctaatcttttatttgaggcatcccctttaaaaaaataaatgattgagtaatcatcacagagattgaatttccagggtattttacacattgacctccggtgtagactatttttaacacttttagcttctgttgtgtttctatattttcaagaggattcatttttgtcatttgaaaaataaaagacaatacaattttacaatttgttaattttaaaataattaatgtttctttttctactcaccactacattcctgatgtgcatgaataattgttactttcatgtatcagtcagatttggtcatggatccatttatctttcctgttccatatcatgtttcacagtatcagcctaatggtgaacaagtgttcaagaccccaatccataatcaggtacatcataccattccaaatacatatactttatttttacattgtttttgcataagtattataaatacaccacaatgtaagcacccgtttcaaatatccttaatggaacatgggatgaagtgctgtccttctgttcaactactgtaaggcattttcttttggcttatccacattaatatgttcatatgtccagttttttttgtattcttatccatttttgattgtccactatgcatactatataagcattcataatgattatacctggaatttgattcaattcactcatatcctccatcagaaacatcatttgctataataccataccttggggtttgtgatgctctattaatgttattacttattataatactgcactatctcggccagattgtcatgctaatgattctgtatgctttgatagttttctggatcttctagttttgttgttgatccccctatatatgatactgaattgaagcccaaggaatctattttcgacaccgaagataaggcccacaacaaggagacaaagcttgttgctacattattcattacctaacagatgagcgttactgttttttaaagttttatttataggatacggccagtccattggatggagaaaaagaaatgctcaagcctctagtccttagtgactcatcccctgtaaggccgagagacctaaccttattggatcaagaagaggctggattggtgtctacctttattaataggcctcctattgacattttcaaaattttgccctctaaagatgatcctgactggccgtccttccaacagattctttccaaatttccagacacgtaagtttcacttccccctttcattttctttataaatatcttaatagtaggatctaatccttttatatagggagcatctttgtcctgatggaggccttgtaaacaactcttttatcttggatattgtcttgcctcaaaaatggattgatcacagagtatgtaatcctcgtttctttcaatcaatagtttcgacaacttgttattttatggggttcgtattttatgctgatttaaacttaggttttatgcatttttccccctttcatatcgctatcatttaaacaaatatgtactaccaaccgtttctctactggatattaatctgtaactatctatgtggatgatcttttatgttcacagtgtcatacatttttatatttagtatcttcccaaatacatacaaagacattgtacattaattcctcagagaactttccttagtagttcagaacactgttcacggtggatgatcggttatgttcaagttgtcattcatttttattttctgttctttacctctcccccattccttttcaggattcgatcaactttttattttatggagttcgtatttttatgttgattgaaacgtattttttatgcatattttcctttttatagctatcatttaaacaaatgtgtactaccaaccgtctatgtactggatttttatctgtcgtcttttcaactatatatgtggatgatcgcttatgttcaccgtgtcatacatttttatatttattatcttcccaaatacatacaaagacactatacatttattccatggtgtactttccttagtagttcagatcagtcccaccccgtactttgaatggcaaccaatcattgaattatgcaccctctcagttcgcctcctttcattccaacttctaccgtttaggattcccaataaacaaaccttttcactttctataaatcccttttgctatttcccctaacccaagacagccccaccactaaccgtaaacctacatatttctccattatcatttgtaccacactcgtattcgcctctgttcattatggaaaactaccaccgtttgtacgagttgtctcccttaataactggttggacgatatgtgttatgattcttcggatttacaagaaaatgctaaatgatcactcctttgaattgcatcttatcttgcaagatgaagcggtaatagtttatttgtaatctttgatttcattttctgttgatttcgatgcgtaatataatacgagtgtttgttttattagggcaagaggatagaggtaacaattggaactcggttttctgctttctattatgacaggctcatagagaatcaatggaaaatgatcagtactttcctcgtgcggcctaattcagaatgcataagatccactccccttgagtttcgaatctttttttttgtagcaaaccgttgttacttcatcatagccgaagggaaccgttttacttaacaactttactccatttgattacattctcgaacactcagttcggaaagatactctggttggtaagtattaccctattttctcatgatatttctccaaatatttactttaatattgacttacacttaatatttgtctcagacttgcttggggcactcattgatttcgactggctgaccaatagtgcgccaaatgggtccgatatggacggattcaagcttcaattcaggttcatcgatagcaagtacttttcttcactacctttttatagggttttctatttatttttattaactctgtccacatagattcaccatttacagccaagatatattgcaatgcgaggcacatggtgaatatgcagttgatttagagaaaaagtttcgttccgttcggaacaacaaagtagttattgccctcgccttttggaaaattgttacgtactttgatggtggtcaccgtatgaagatcgccagccatgcgcctatatctactgtttatcccgatccagatattgagccagtcaaagaaatcaaaatggtatgtatttactaattcgaagtttctttgtaaattcatttcttgtgttttaaaagtaacgttaggcttctgtaattttcccttaggttgtctattaaatctggatatatcgagtgaagccaccgttcatggataatgtctttttttttcattgctgtccaaatgtttccgaacacaattatgtgtaacgaaccttttgataatttatcttccatgtattcggatatcattttaatataactgcctaagttccttaatattatgaaagtcgtgaataatggttcgaccttatatcttccaaattatgttttacataatataatcaaaagtactacatcaacagaaccataaaccacgtcgattcaatacaatgttaatatcgagtaaatcaggatatatcgagcctagccaccgttttatggagtatgtcttattttttcttcattgttgtccacatgttagcgaacacaattatttcgaatgatcttatgttaatttctcatcaatgttttcggatgtcctttaaatatatttgggaagaatattagttcctttatgttatgacagtcatgaataattatttgtctttaaatcatccaaattatgttttgcataacataaacaaaaacccaacaacaacgtcgattcaatacaatcgattcacacacatcgtgaatatgttctttgagcttgctctcctttccaacagttagtcttctatgatcaccaaatgatcttcctctctttaaacatttattcttcatacttgttgttgtttccaaaagtttttggtcattgttttatgttcagctgctataaaatttgtttatgatataattttctggcaataatgttggtcttttgtcttttcattgctacaactctgtctctagcaaacttcttacgattttattcgagattgatctccctccaacagtaagtcttatacccacatcaaatgaacttcctttttttaaaacatttattcttcatacttaatagcatttccaatagtatatggtcaacgagatatgttcagctgctatggatttctgatacatttctctgtcaataatgttggtcttctgtctatatgttaactcgttttccacgtacatatggttactgtcccgtcgccatatttttcaatttcgtcttcattactttagggccatccccctataaaggaatacttatattactttttcccttctatactaatatatcagctttaccaaaatatctttaaattcttattttttcttcggatggaagtcgattggaatccaacgcaatctgtagggatcttgtctatatgttttcttccttatttagttggcttactttatttatgcatcattatttacttgcagatggctgtgtttcgggaatttcacattccggtcaccattcttgcaaagattgttagtctcgtgtctgaaaacagtgttgatgatttgaaggcctggattcaagccggtcgggaaggcactgaagctgtgatgtcgaatgaaacgttgagtcgagtcaggcttgataaatctgaacattccatatggtggaccgtgccccattcttcttaccacaagtttttcttgaaatgcctttctcagaataatccattagccatgttcgcttatatgagtaaatcttgggcttatcaaacgttggttaatgctcactaccgttttgggcgttgagaatcatacaatggtggaattgcagcttacaacgagtttgttgatggacgcctcactcacgagagattaacggatgtcaaattttatgtcttcctcctactaaacaacgtagaatggttcgacctaggtgcggccgttgttgtcggccaggtcacattagcacgaattgtacacatgtattttattaattttgcaatttttgctactctgataacctcgacgatatggtatcatgttcgcggttttttggttaacgactatttctgtttatttttatttttttttttaaccttagtaaaataattatattattatatgtgtattaaacattcttataatttggcctccaaaatattcactatatggatttaggctttaccatgttttattattatttgtttgtgtggataaatccaaaaaatggttgtccatattcttcagtatacagaatgtcttagttatttaaaggaatctcatattttcacattgaatttcctatccacaaatttgcgtccacatattttaagtgcagtagacttataaatacccatattgacctgttaccgaattgtacatatttattaatttggcattttgttatttttcaacatacttgaaacgaactcatgtaagggattttatggttaatgacactttcttatgtttttatttaattgaatagttaatttattatttacgcctatatatacacatctcgatattatgtgatagcaaatgtcgttgtcttcctctttcaattcgtcccggaggcgtaacaattctataagggagagcgttcagaacaattttagtgctcatgatctcaaatgtttaatgtttgccattctggcttttgtatttgtcgtactgttcattttataattactcatattgttgattattctattatttcttattaatatgctactttatcttttaatatgtgtattatacatttttataatttggctctccagaattttcactatatggatttaagcatttaccatgttttattattactttgtttttgtggataaatcctaaacgtggttatccatatcttcagtatatattaggtagtattgcccagatttacttacaaacctgtttttgtggataatactcgataccattaaccatgtgttgtgatttataatgaataatgtgatatctggatgagagtaaatattacaatatgtccatcttcaatttcataaaacatttttagtaactaaagtttctaagttagacattatgagagtagtatgatgtctctagacagataatagtagatacattgcatacatcgctccccattgtattctttacgctgattatgggaaaaccaacagtgtggaaaatccacgaaatgccatgtgtaacagtagtttccgaatcgtttgggaccgattgtgtttatatgaaacattaattcgtctgacattgaacttatctcggaatttccagtagttcttttccacaagcgtgcatgcacaactttgtagcataattagtaatagagccgcgactaggtaggtatgttgtactttgttcagtaccgaaatagctccatcaagatctaagttacggaatcctaatttcaggcttacaacgtatagagcaaaaagatttttgtttttgttttaggcaggcagaataaaaggcgtagtaagtactagaactttctgaccattggacaaaattttcgttcaggtctaggcgtacggagcttagagtcgccggagagtaaaccgcttttttaccggcccttcttgtgttcatccaacttttcaatacatcaactctgtctctagcaataatgcttacgattttatccaaaacatcttggtttatatctacaatattccccatccgtttctgcagtgcaaatatgtaagagtttaaacctagcatgaagcaattatcgcattattaataaatcaaggtttgagttatgttttgaaccaaccttctttcccattgtaacaactcttggccgtacactcgtttcctgttagaacgtatagaacgtctatcactatattttctttcttccttgtactctcccttttgcacaatgatggttttctcacttatatttatatatgtaacttattgataactgtaattaatattactgttttatggataataaccatgactccttgtttttgtaattattctgtttcattttagttatattaggtggttactatggatgttatttttataaaacccagcttactatatggtcaagattaaaatatgttaacagtatggtttactttgttgtcaatgaaatatttgtaaaaacagtcgtcaatgactttgccttttagattgtaacagattcaaacattcgatgatgtcttagccattgtacaacgtttttaataaaaccaacttaaattgaataatctagttttagacgatgtctaacacaaacacctaaccaaacctcactggacacatatgtccgtttttcttgcaaataggacattttggcctgccagctctcttcaatggtgggtttgtaactagctcgccaataaatggatcttccatacaaagtcgaccatctatgaactccatatacgctgataaatctctgttgaaggaaacccatctccctagtcggaagcattgtgtcatcaattcctcgtaagcctatcccttactcatttcggtaaagacggcggcagggttaccttcggttaggcattttttgtaaaatttatggtacgttgagtgaggcatgaaccaccaaataaaatgttacgatttgtcaagtcccacacgctttagtgtctctttcgacaagacaacatccttgcctgcatgaccacttcgaatccaacttttcaagtcttctacaccgttttccgaaactaaactaacgattttagccaataattccgctggcatgtggaactcctgctttctttgtaactacacagtaatattccatcgtcaacataaggataataaacttgcttattaaataattcacgatgtcagcttaccattcacccacttctggttcgttccattttcctgttctccattttccgccgatgaagaaaatcttgaaacttctgcttactaatggcaaaaagttaggacgaaacaatttataagtattttttaaccgtgctatatttttatattatttcaggctgtttgaccacatggataatttactttattttcctacatgttatatatattcactgatatagggaattatactataaatttatatttaataaggtttattatatggacaactattatccgggtatgtgtgatatccatgtggtttgagtgcataattttccttttctagttattataaattttatttctattattcatttctatcgttatctcttatcagagtaaactacacatactccccaattatgctcattcagttcacctcagtctattatataattctacaaatattatttgaacatgttgatagagaacgaagtataagctcaaatatataagatctgaacatttgtacgcatcctcggatattcatttccactatatatattattatttaatttaatagatcagggatatccttaggttcagtgaaggatacctacaattttttttttaagtccttctaatgaaccccttcattccaattccgctgctctctgacatcattaggcggatcggccgtcagggtttccgggagcttgctcctttcatcgccgctggtaccgtttggctggatattgtttatagtaatgaagttttagtcgatgtttgtctggacaagtttatattcgtctgctccctcgcgaatgttggatctccttgtcgcccattcctacttaggtgtttggctgctcaaaactacaccgcgaaatacgttgaacggttaagacgtttggctcaagaaggcccttccatatcatctctcgatatggtcagggaagccgctcttcatagtaattatgcccgatttgcattcggtatatttctaaaatgttgcggttctcataccgagggtaatatggtactacaaacatttcatcaaagggttcctattttcgaggaggcagaatatatcgtggatcaggtgattacccaaattcgagacatggggactccaggttgcggttactacatgggtttcaggggtgcaatagatatcccagagtgtaggcttcagcattacactggtgtttgtcctttgtgtttctcagttatgtatgtatttgaggtcagaatgctttgttagttatcgttgttgtagtttgagtaagcaactaataaccaaccttcaatgtttagtttacttcccgtcttgccaaatacattatgcatacatatatttgttccattttgtaatgtaagaaattaataaaatgacgaccaaaccagcaactataatatttccaaactcttttgaaatccctgctttcttccccccgatttccttttttaataaagcgacagtagtttgatgttgtgtgtgaagttcaaaaagttgctctatctcttccttgtgagcctctattctttcacgcattttttccatcttacttcttcgcatcctctctgtctcgtcctccatttcacaccttaacactgttgcctcctccatcattgcctcatcccatcattttccgatgtgtacctctccatcttactttaaaagtttggtttctatatacatatatacaattttgctaaatatttttatacaactagctctttaatattctttacctccaccaactcgcatgcataataccttcttcctgagtaatttcttccagatgaatgtttgataatcgttggtgctccacagtagcatttttttttggaattccatactcactgttattacggccgaagtttggcctatccacagatctagaagaactactgtcagacatttttcttactcttttgttcccttaaccgaactagtcaaaactacttatactgatttataaatcataattccgttaaagtgttgttgataattcttgtccatcatgatatgcgttcataattaatatatattttaaccacatgttcgctatcatggatcgtctgtataagtgtcattttgttagtactcgttgctacaatataatattattcaagcgtacctcttgggaagagagttaatcatttcacttgggaatatatactccctttcacatcattttgaattttaagaagaagcggtcatacagtaataataaaaacgaagtataattacccctaaacataggtttatcatttgatatctactgctgttgtctactggttgtgttatacgcaaccttgacgtacaatggaaccaccacttgacgatatagtaatttaattttgctggctaattatcaccacattaaattttttggcgagatatggaaagttatataatataatcaaattgtagtttaacatacgtatccatatggatcatgttaattattttagatgaaggggacataaattgatccatcgaaaccatttctttttccaaattcgtaaaaccagcatagttaaagttgtggatcaagtctgtactaagagatacataacaaaaaaattaaaatagccgaatcacaaacattcacttcatagtcttaagtagttcattgtaagacttcaaaaaactttcccaatcttcactccttaatcttcactccacaacctatgaaattgatttaagtgtatgaggtatttctttatttttaacataactcaaaagtattgatgttataaaaatttacttaccattctaatctcatccacttcttcaatggatggttccggggtaaacagttgatacgcctccataactcacgatcttaacatttccttcgactgctgataacttaaccaccctccaccaccccagcgccacaacgatgttaggtcttccgaactgtcggtaacatttctcaaatgtaatagcagttttccccacagtatcacaatttagagtttttttgctgaatgttgttagagtgatatcattacgagagtatatattgaatgtaaaaaaaacatgggcagtgaaaaaacgtactacttatccatgatcttgaaaggaagtatcacctcctcaccaccctcatctacattccctgtgtgagtcagcacaccaacttcaacaatggctccaagcaggtctgttgtaaaaaatttaaaacaatactgattatgattgttaaaaccaaatagtcaaaaacaaatacggaaagaaacttaccaactaacacttcagtatcataagtttcctccaggatatagtcgaatcgagttaaattgttgaattgaacagtaggtcttgtatcagctgatgtcagttgttcttttcaagtttttcgaaatagtaagctgaaaacctacggtgaattacaacttccatgcgctttccctatttaaaatttactccatattagaaatttactccaacgttgaagttttgaataaattttatgttggaaaaatcacataccgtttcatccgcaacgattacccttagttcgaaagaatcgtccctttcgtactttttgtatttcctcatgacggtaactcttactgtccatccactgagttaggggagatttcgtgtaagagatggtatttcaacatttacttcttttttcaaggttacaaataagtattaggatttcgttagttatatactaaacaaggatatatatacaaatagatataagtattaccggtttaccgtataatataccaatcaacattaatatttatttatccgattatatttaatcatcagagcatattttacaagtttatgttcatttttggattatttatccacatggtcaggatatttagttttcttaaaagcatattaccaatttaattcacatttttttttattatgtttttaacaactatgttgcccttatgaaattcacattttgtcacatttttaacaatttaattcacattttttaacaactatatttagttcatttttattttatttttttaacaactatgttgatcacttatgaaattcgaaacttaaactatattaaaggctaatttttgattaatatattaaattaaaagagtattttacatttatatttctcacttacttagaggctcgtagtttgatggcttgttttctttgaacgtattttggttatccacatgatcaacattacatattttcaacgtacagaatattcagtttttaaatatctattatgttctactatatcaatttattaaagtacaacatataaaaatcttttatcgaattttttccactagatatatgttccgcgctttatttttggttttatttataggttttatagtgtatccacatcgccaaaataagttatttccaacaaacataatatcaaacaacaataacttacacagccgatcactcactcgattcatcctttcactttgttcaaaccaatgataagtatgcaacatacaatgacagcaattgacatctttttcatgctggctttcgattccaacagtttgtcatctagcctcttcacaatttcattatctagcttaatttgcatcttatcaaaaacaactttctcctgatttatacttacagcaataaactgggacattgtttgtttaagagcattcgttcttctagccaatcttttgatctcatcaatcattgcttcgtcaacctatttgaaagtgtggttatcatcgatcagcttgaaaatcaattaattagcatatgaatttgttataatcaaacaaattttcattcacattaccttatgtcctgcagcataagcacaacgatagtaacgtctgtatggattcgtagctgacttggatattaaggccgagatactagctccacaccaacacaatttcggcacactctcaactcttcttctctaacagacatttgaagttccacttgtagctgctaatgaattactcattttttagctcaatttgggaaatggttaagaatactagaaattagggttctatgattttggggattcttgaagtggtatttatttctattggggtcacttatatcgggtttgaatttggtttaactttggtttattatattggttattggtttgctctctgggacagtaaaccaacaataaaccccgaaaattcattctttggggttccatacggactttatatttagaactttatatttcgaggctttaaccatatggtcgaccttaaaccatatggtcgaccctgttttcttagtgttccacaatttttaccttttttcattatctattatgaaattagcaactgatactataaaaaggctaaataggcattaaaaacaatttaaattgtcttgaaataagaattcatactgtatcatgatcctcacaatggagcatcaataaaacatccggtacgccgagtacataaccaaacctacccaatggttgttcaaaaaaattttaaaccatttaaaggttcttcattataacatggaagattatatagggttgctgcaacgtgctctgttgtgtccaacccctttgcaacgcgaacatcttatttggttttaccttggcaaccttcacttttctctggtcattcatagacaagtgttaaattcgtgaatatatgttcaagcgtaaatttaaattaattaccacacttacagggaactctcctatggaagctattctttttgcctttcgcctacccgacggcctccttgtccttggtggaagaatcacacgttccttaacttcttcactttgatctaactctaaggcattagcctcagggttaacaatgcctttgtaagttaaaacccatgttttggttttgaaacattccccaaccaaagttccaaaatcaagccctatactgttagctgcaagcatggcatgaccgcaaggaatttttagtttatcaaaaactttgcagctacatttcatatcatcaaaagaaaccatgtgattccctccgaaacgcccaacaatctcatatgtccagtttgtgacattttggattttgctcccttccattttcatcatagtctgggccatcaccttgtcaacgtaaggttgcaccattcctgtatgtttgatagactttttccttcgggctgaacaccatctggttaacatagccctaataaacttcaccaactccaaaataggtgcacatctccctaaccgtattgcattgtttagagtttctgcaatattgctcgtcatcaaattatacctctcaccttggaaatacaccctactccaacgggctggtccaatcttctccaaatatttgtcacattcataatttcttgattttatttctttgtatagattcctaaagacactcatcttgtacacacatccaacattcaacaccatctttgctaatcctttgctcttatatcttgatgtaacatttcgttggagatggactatacatgctccctggtgtgctagtggaaaaactctgctttttgcaacgtataggcttggatgtctattagaaattattgttagtgttgcactgtcatcaataattctctctaccttctacataaaccaagtccaagcctcgtccatttcactatccactacagcaaaagccagtgggaaaacttgataatttgcgtcttgtccgctaggagtcaataagaccccttatatttcccggtcagatgagtcccgtccacaaccaaaacccgtctcaaatatctgaagccctggattgaggcaccaaatgccagaaacatataaagaaaacgttcatcaccattttcctcaatatctgtcacaaggtctgtcatactacctaggtttgtcatattacctaggtttgtcatctttataagctccatatattcagctaatttggtgaagctatcatcatcctcccctaacacatcaactactgccttttccctagccctataacacttgctatatgatgcagacactcttaaatcttcaagaatcagcttttgcaaatccatcgggacaggtcctttaacaggctcactatattgtgctttatacacagctgctatcacccttgaagttgccttcttcttgtacattttccgagtttccacagaacaagtatggtctagtttagctttgcgtatctcataatatccactctcaggcatttcatgagctgttacccgccaatcacatttctcatcggcacagtttaaaacaaatgaatcaagttttgtgcgtgtttgtttgaagtgaaacatatgcctaatagcatatatagctaatccaatttggcaatccgacttgctagcataaacttttcctttatatacatcttcaccgtcagccctatctatatccggcattatggcagcttcatactccgtgtcatcaaacagaggaggaatatcaaactcttcatcgtccacatccgacagcttcctattttctcttgcagtttcatttgtattacaatcacctgttctattgttaacaacttttcccgttccactgctgtttgcaagtaaatcagttggatgcttaatcgaagacgttatcaaatcatcaatttccatgttcgaacctgcaccttccacactggccaccaattctgtgtctactgttggtgacgcaaatcccattctaacatcagcatcttcttccccgacacatattatatccaatgcatttgagccacccatgtcctcatccaagaatgggctccaaaactccacatcataagattggggttttacttctataatctcatcccaagtaagatcttcgcttccttcatccactagatcttcatcatcaagatcttcagataaaatttcactaacaagaggacctcgttcacaacctataactctttctatagtttcaagttctgcaacaaattcttcatcttcggaggacagcaaaaattctttcaacccgaccttcgatatactatcttctgatccacataaacgtttcgacttattccctcttccgtcatcttccttaactgaactggtcttcactagcccaccgtcaacctcagaattgtttaaaactcttttacaagatgttccaaactttacaaacatgttggttccaacatttgcttccaatatcttcataaaataacttagccccacatcagtcgtcacgacgaccggtggtgttttatctccggtggtaaaatctcttatatttggggtacagaagcttaaatcaaccttcgtactcgttgaaattccaaattctactctaatggcttccacgaattctgatagcttaatacctttatatacaggcacaattcgagatttcattaccttattaacctcaacataccacttctcatcctcctcgcaattccaatccccgcatattacataacagaagccatcctcagttccctgcaatatataaattttttatcttagacagtcaataatatatcagcgaatattttctactattgttaccaatccattttttcttaccatcgttatgatatctttgttagttgcttcaaacttcagagcttctctttcttttgttcatcgtcattcaaacttcgatgacatagttattcgttccatgctttctccggtttgcaaaaacaaaataaaccggtttccccaaactcttaccctaaataaccgattttacttgatttaattaatagggtcaattaagtctttttcccccttataattgatcacccttataattgatcagaagtgtgcctgtcggcaaaacttttgctcaacatgttttcgaaagtgtatgataatgcaaatcacccttaaaatataatatggtaaaataatttggtggtgttagctgaattggttacgatacaaacaatggtttgggtggttgattatacaagaaaaaaaagacaatgactttgagtctttgatttacaaaatcatggtacaatctaaaaccaaatgggtaaattaaattgtgttattgggtagaattgtttgttccaatgcaaacacatatttttttaaaagtataaaatcatcgttaattataaatgggccgatttgacccaataaagccttgataaaccgggctaagccgtctgaaacccgacccgggtagttctaactttttgaccctaaaacgaaagacccttctctagcacgtcggggttcgttcaaagatcaagatctgcagacatggcggacgaagcaaccagagctgtgagtacctctctctctcttaaatcagctcaattttctagtggaatattcttctttccccagtaagatgttgcagaaaatggaattgtaatgtgtatagttacaacaggcttttatggagattcaagctagcatgattgaactcactgggaagctcaaacaggtgaatcctcactttctttgtatttatcaagttttagaatcaaacgtgacacattgtataagggtttacttgtaatttgttagttcttgaactgtgtttggttttataatcccttctttcatgttgtgtaatgacaaaattggctttcctaggttattgtcatgtggtgctgaaaaactgaaatgtgaatgtggatgggttttatatataggtgcagaatcagatgcgcaacaaagagggagatagaaagcgagctttcttaaccttggaggagctgaggccattgcctgaagagacaaacacctacaagtcaataggcaagtgattcaattctctggttttgagacaaggactagtaaagttttggtctaatttgtgttttattcttgttttcaggaagaacgtgagtggtggttattagtcagtccaactagaggcctttagagaattttgaaggctgattatagtttgtatggtgaacaggtttgttctagagcccaagacagtgctggagggtgaacaagagcaaaaactcaaggacagtgaagctgccgttgcttctctacaggtaacaatcattccctctttcaacatcttattgggttattaggagatcattgagatgctggttatcaaacatgttttgttttcgggatgatttttagacatccaaggaatacttggagaagcaggtagcagaggttgagaacaacttgagggagctgttgcagcaagaaccgggcattgctcaacagattatgtccatgtctatgtaacttttgtattatcccaaacctttgagtttggagagcttttgggattgaaaccataacatgttctagttaaaagttgtaacattcaaaagtttttgttcgatcagtattgttttaaagcctctggtctatgatattgcaaaaaactgagatttcttatgcgacaacaaatgcatgatctatctaactcgaaaacaaaaattttaacaaggatgaggtctctctatgattcttcggagagaaaactcaatccttgttccaccgttcggtatgcttaccggctttcgttgtccggatgagaagactttgtttccggtgtggtctggctctgttttcggtgtgattcggctcatatttcgggtatttgttgctaaaatggaattcgctttgtttcttgagggaagattaggataagtcgattgaataattttccggcgatcttggccggaattgaagctttctgatcaacggagactctcacatcttcaactttgcatgtgtcttctaacctgcttcctgcttgccacatgtctaatataatgcatttaagcttttccttcagctttcttattggactttgttttcttttgtttggcttccttggtttagtgtttgtaaaatattggcatgttactttggctttctatactaaataaaacacacttttgacaaaaaaaaaaaaaaaaaaagactacaactcgagattgcatctaacattgtgaatatatataaatttaacctcacaatctaaacacaagtagatgtaatatatattatgaattcagtgaaacaatagttaaaactcaagttgatcaatcatcaatagcatgtgagcaataagtgtcaaaagagatacacatacacatcaaaccccaacaaatacattccttcatgtacactgattttacactacctcttcaaggaaatcatggatcataatgtctattggcatctaagcaagtccacttaacatatccatagtgtgttggcttctacgtctaaagccgttccccaaaaattcaagattgattgacgtatagaacaggaacaagtcccgccatcttcccatctcttccaggccgcttcttctttacctgtcgtagtttatcagttgatcccggttagtttacggttttaaaaagctctactcctcacaagattttagtaaccaattactacttacgtaaaaccagccatcaacttcatactctatctccaattcctcttctgccgtcaagtttagctgcaacatacccatacgtgttttaacgtttgcataatatcatatttttcaaccgtatacaaaactaaatgaataaaagacaaaagcaagcttacctcatcatctcctcctgctgtgaagtcatagagcgctgttccaaatcttgtaccagtagatttcctaggttcttcatcatctgattcataacttcgagaaccagaccctgctacagggttctcaaacgattcacgactttgtggctcagaatacgaataaggcggaggaggctcttctctaatctgaaagggagaggagaaagaagaataagagatggccatgaaaacagagaaccagcccaatttacacgacaaaaacacacaaaattatatccgcttactggggaaccatagccttcatatgtggactggtatttacttccacctgattttgcctatatgagttacccacattcatatagttaaaattagctggcacgaaaataattcataagttcttcttaactgaattgtgtgtaccctaccgttgcttgtgaggaaggctttgaactgaacaatgatgggtagttcattccaccaaagtgagaggatattgagctttccactgatccagcagaatctggagacgatgaacctgatctcgcatcttcttcctgtaaatacaacaaaagtcattttctaacacccctagaattaagttattttgatgacagccctgaagacagattaagctagcagtatacctccaattctgaagtttctaaaagagttttagcccacatgtcatcatacccaaccgaaggtctagagaagacattctcctcctcaacatccggtgcatctgttccgactccagcaatgaattcattgacctgacaagtattatataggtctgagttccatttctagacataaaacaattggtagcatttataatcaaatcatgtacgaataaatacagtagatcagatgaatggtttaactactactgaaacctgatcagaaaatttaattatgccttattagattggcacctacttataatcagaaacggtaatacccaaacttctcatcacaagtgtagtcccaaagcattcattcttgaccccattcagactagtcgaacgtttactatgtctattttgaaaacaaggtactctaacgggcaatccacacaactactcttactttctgattccttatcagaaatatttaattatgccatttccttgatcttaataagaagaatatctaaatagacacacaagcactaaactgcacacatactaatccgtttatcttaaaaggtcagataaaaatagcaactgaccctactcattgctggggcattgtttccaagaagaccatcatcaccaaggtttgcagcccaagcattcaccaaatcatcatccagaccactggagtttgaggcagcgggggcaggctgagtggactcatagattaagtccgagatcccagtagcaacaacagctggatcggtggacccagtagatgcagtgatattgtgctttgtacggtatgtgtcaatgagcttcgcgcttcataagttacgaggaaacaaaataattattatcatatgaaacctaaatatagacaatagcacctaataaaataaagaaaacggggaagtaagcatgcaatttacacaacaaaggtcagcagcaagatcaccaaagatgaactgtacattctggacttcttttgattaaaatgtttcatatatagttaactatagtgtataatcgttcttgggttttgtcagaatctgggataaaatttatacttttatttgtcctaatgaataaggataattacatgcaacacaataaactctgttgacctagataagcattcacaaaaaaagcagaaagtgttttggaaactataaatcccatcttccctatacaagattagtattgtaagtaagtattatgtattagaagttaggctgtctttgactgatataataagttcagaatactaccttatcgggcccagtggtaaatacttggctctaggaataaagcaaaacattgaaacaaaatccagcagcctctcatggttttcgtagagttttttcagctcctcgtccttccattctttgtttgcattatcgtgatggcgtatatcccttgttatcaaggaaaaattcatatgtcaaccataatatcagatagaggttacatgcacgcatcacatgaaaaaaaagaaaagaagacataaatatctttcttacttgattaattcgtcttgtccaacatacatttcatcaagaacttttaacatcggtgttattaaaactccaagacctgtaccactagctccttggtcttccccattactcaggtgcatttcagaaagttgagactgtacaccaccctctgctaaggtgtacaaaaactcgtatatctgcagcctgaaaggttcaccagatctaatggctattgtagtaagagcttgaattgcaacaattctgacctgtgtatccacaaaacataaacatttaggcgggaaaaactagaagtaacactcatcttagtagactattctggcattattgtgtctatgcttcacaagaatccaactaaagcgctaggaagaaaatcatatacatgatgtaattaagcatcacaaattatagtcagctattttctatattaagatatctaaacagatagtaataaagagagaccaaacatgattactatagtcaacttgcactactttgttcttatagtttctggtcaggcacaattactacaggtttcacattctgtttcatggttaaaaaaaaaatcattaaaagctacctaactagacatcctattcgttctcacttataaaaaagggtctcaaacatggtcttcaatctagagtactcaaatgatgaatcaaatcagctacaaaccaaaatgttcctagacatgggttaggatcagtgaccattgcaaggcaagccatctacaaattgataagaatatgggtatgaaaatgtcctacatacattgtacaggaggggaataaatcaaagccttataagacagaccaaagggcactaagacctttaagctagctttatagtgagttctacctactttgtgggattgctttgtgccctacttctatcacaaattgtccaattaaaaaaccaaatcaaaatatacgaccagcgaaatatagtggtatacctcccagcttccactaaatgcacacctctggaggcgagttaatgcaccagctagagtaggattgcgagaactagcagcagcaaccattttatctgcatccaacatcataagtgctgtgcctggtggagttgcagattcccatgcatattctgatgcggcgtagtttgcattttctccaaggaaccatacctgccacagtattccttttaagatcatgtgttgaaaacattaccaaattcatgtaaaaccttatgaggaagtcttactgctgcttgcaccaatttctgcagcgccagagctgacttaggatctgatgcagagaccctatcaattgatgtcagtccagccatggaccccggttgtggaggtggtagatcgagtactatcgtgactgcttccagagctgtgtgtttcccgtcaggaccagctccaacaagacatgtctagaagtcaatcagatgataaattgtgttaaaaaatactatctgaggtagcaaaaattcagtaaaatatcccacaataatttaagccttgcaaatatacagtacaaatatgatttttatccaattatatagctttaaaagattaaataaacaagcgtacaaacttaaagatctaaaaatgtcctaaacacaataaaaatttgaaacaggacgaaatatacaacctttttttttttttttttttttgatcaaaggacgaaatatacaacctatgtaagtaaattataatagctttagaattatatccgtaagaagagaataccttccatagcagctgtaagacatcagcgtcaattttccctggaactttggtggcaaatattctggcaatttcgagaagaataacagccatatctggagttgcctgtgaaagaaaaattaaaaagagttaactagtcagaagaaaacagttaacattactcctcaataacaagtttttcttcagtttcaacgcaatggataagaaaattgatagagtccatggtgtaacatgtttctgccagataactcttgttacaaaatctaagaaattaaagagattccgtacatcagagaactactaaatacttataggattgtggacaaacaacagagctgcttaactttgaaactgttcgcaactacactggaaaatcaaaaaagccaagaaaacatcatacttaccttaaagcgggcatgcaaagtaagcaaaacatcattgactagagctgcaggccaaccaggatctgaaagctccgaggcaatgattgattttaactcatccaatgattcatctggactttgcatccatatcaatgctttgataaccattgcccggacatacacgcactcgcatgctactgttgtccgaaccacctccattaatgcagctagcaaacttgcaattgtatcactgcgaccaggccctgcagatatggatgatgttctccgaattcctgcaaaagtcgaacatatacaaagtaggaacatgttagaacatatatagaattcctgctaaaaataagggtaaacaagtaaccaaagagtgggaaagaaggtaaaaagtgatttggaacatgttaaaactcgaaagatataaggataccctacatatttagataattcggtaaagaaaatcaaagcaataggacagaaaaacatgttcctttgtttacgtctgaagagaagactgatattatactatttttgtaaggacatcagagcattgagtttactcacatttgtagttttgtaacgattctagcatattgatgcgccatcagagcatagatgcaatgacttaactcacatttgtagttggtgacctttcaacgtataataaataataatacaacaaaattgaacaaaactcttatagaccaaaagcttgcatacaattttatgctccatacgaaattagaaatatatttgtgcatctgtcagacatctaacaaaataaaaaaaaaagattgtaattcatattaagaggatactgacaatgtaccttctggatgagaactttcattggtctcagcatcatctagagcatcagaaaatgcatttacatgaacggattcatcaatgtcctgtaatcccatagcaaacgctgctgctctactctttcccatctcttgcacaacccttgctgctgcatgaagtactggtcttgagaaactgcgaaatgagctctctaacctgaaagaacaggatcaatttgcgaaagttctttaacaagaaacacaaccataacgatcattacaatccaaagcaacattctagtgaggaaagggaatccataagatctgcaattctaaacacagtcttccaccaagctaggagtacctcctcattacaagcttaataaggggctgtggacgcttggttttattagatttatccttggaggacaaggatggtgcttctggcagcttcaggatctctctcgtcaagcgataccacccagcagcacgctcatccatcctaaatgatgcagtacattttggttattcaataccttacaaagaatgaactaagagaaatcaaagtcatagaactcatgcctctcagtgttatcgtgttttcccagaatgcacaaaatcgcctcatagcataccctttcgcttggatctaggagtagctgatagagaattgagttgaactgagacctaatatcaggcctctctgtaggaagattgaaaggaaactagcaacatgtaagttctcaaaagatctctcccatatagccagataagaagaaaaaaaaacagagcgagaacgggcagcagaaagaggttgatagtacttaccatctaatgcccgagctctagatattgagtggcacaacctagccagagaaactctagcaagaacatcattcatatgcaggatatcttgcaaagcccctaatttggtgtacagaagaaaggtatatcagctaacccagatcgtgttccaaacacttctttataattagcacaaataaacacgaaataaccagcaaaaagattaacgtcaagagataaaaggcctggtgagcatacctgttggagacgcaagcttttctgcagcaaaaagatcaagagacacatatcaagttttgaatgaaaaacagttatgtctctacacacagaaatagaatgaaaaaaacaatataagggggaatagaacaaattatttacctaatgtcattgctactgtataggggtctcttgtggctaactcagatagaatttccagtgaatgcctcaccgcaacaggatcagcaaagaaaacactgcaacataaaagtgtgaatacgagaataactgtccaatatactgcataattaggaatagaccaaaaattcaattgctcttgtgaaacctacatcactatacttaaatccaatactctatacttaaaaagatagtagaaagaaccaaaaaaaaagtcttacccctgagctgcacggtgcagaaaaagtggatttcctggatcaagagggagtcttctcagtgcactcatagcagcgtattgcaagttacttcgcataatcgactaacaaaaacgagataaaacgctcaagttaataacaaagtttagtgttgaccttctgcaatccagaagctgtatactcaagtgaggaagaattctattcgtctgcctacatatctagaagctaagttatcaaagttgttcctttggcttattgataatctgatatacgaatagaattgtaatgttttaaaaaaatggttttattaattcaaataacatttaactcgggccttaaaaatctgatagctaatagccagagtctccagatgtgcaaactcatatcattatagagcaactatgatacactgcctaatgcatgcagtcatcaacaagaattttgagaaatttctaccctacagcaggcaaagaacatgcagagcattgtaaaaaagaaaattataaagtgcaggaacatgactagtatataagccttaagtcttttcctggaggaacctaagagtttagaaagatacctctttatcacccccttttgtcccaaatacacctttctttcgtttatgcggaacatcaccaacctgaaagcgacaagaaagataaatcagggcctctgcatgtcactgggaaaacccccgtaaattaaaccacactcatatgaaaagcaataagaataaaatagtataattgtatataaataagaaaaggtgggactacggttaaatcacgcagagtgcagacaatgaactacgccagggtttattaaaaataaacaaagcatcttgttaaaaatcatagagcattggcagtcagacaaaccttttcaagaatgccaaatacaatctcatacaattttgacaaaagctcagaattgcctgatggtgaatatgtcagagctttcaaagcttgcagtcgtcgagcatgaactgaagaaaaacatatgataaggttagaaattcatctccagtcacattacagatggaaagttggaaatctatcttagatgttggttctcacttccataacccccaaattatttaaatccataccaaaactgacaccacatctaaacataactaccttttgacgtcactcctctcagcatttgggtctatcaaaagaaaattataaaggtactgggatatttcttaaaaaacattaacaactaataccattataaagataaataagattaagacagtccaaggcagaaatgtataaaataaaacactaaagcctgaaaaatgcgagtgaaactcacattcaaattcagaatttgtagcttcgtttgtaagttgattcactatccgaggaacaacatcagctcttgtgactcctccaccagcatcaatatctgctagagcatcccagttaggagtggggataccaccccctggagtcatgcccgtatcggacaaaattctagctaggtaataataaacatatcgtagcacattcctgtcttcacattgctgattaagctgtatcaatcacaagagaaaaagaatgctaaaaacctgatgcctctctttgacggatattgtttttgaaaatgcgaatttgtgaagatccatgataatttaatgggtagagaaaaaaaaaactctaatagaacaaatcattttagatgctccatcataaagttataaaaaacgatacaagaaactgtacttgatctgacactatctggtcgtcaaatgagtaaccagtgacacataccataagaagagatggggccagagaaggatcaactgagttgtacacagcaagcttagggaacacgtgattcactagttgtttctgagaacttttctgctcactcgcgaaaaacagaagaaacagtcagatactattttcagcagaagaagagaggtataaaggcagagcataagaacacaaacttaaacctgatccaaagtggcagctaattcatgaatgctccttgcaagttgcgaataggaaaccggctgggaagtcatttgcaacataaagtcgtgttaactacatcgaagaacaagacataggtatattgactcactaagactctatttacaacagagactctatatacactgatacctcctattaacaattcaaatctacaaccacaatctagttttcttagctccaatgatccagggtttagttcaaacacagataaatgtgccaaacaaaattcaattagtagatcgaaccttctttttctgtctctgcctttgtggcatgatattggccttaacaggattcagtgcagctttagcaacagatatagtgtcgttttggatctgcatcaaagtggctctcttcgatttcttctctcctagagtcgtcttcgtcgacattggatggtgcagatgggaagaagacgatgcggaagcagaagtcggctgagacgccgtggaagatgcggacgaagaagtagattgtgcaggaaccggggttggatccgccgagatcagatccattagcgtggtaccagacgattcctgtaaagaggaaaatggaagaaaggtaaacttggattcgattcttggccggtgaaatacggtgaggatccgacgatgcttaccgccatagctagtggcagatcggaggaggattctcggagaggattttagtgacgggcgattcaacaagacaaacgcaactttacaattttacaaaattatcaaaattctacacttttgttaaattatcacgaagcacgtgagatgcacgtgaatcttttatttgtcatccaaagttttgttttggtattttttggaaaaatgtcaaaaataaaggtaaattttcaaatttgggacgaaaaattaagatgtaaacctcaacgattaaaaagaattcatcatctttgcattttttgatcaagttttctcttggaaaaaacttttgaaattggttagggaaagattgatcatgttctgaaaattgtgctgaaattaaggtttcttgttctagagatattcttctacttaattgagttcgtgttgtgtaggatgcgatgagttgacgacggcaagatactcgcctatttggtgactgtgacaaagggatcgaaacctaacttttattaatttgggcattttgttataacctatataaatatgtatgtttctgagaaacaaacaaataaatgattcagcttagtcggtaaaggaatggaaaaaatgtcaaaaaaatccccaactttcaaatttgggacgatttaatcttgaacttcacagaagacaaataaatcgtaaagtttgtgttgacattctaaataaatgacaaagtttttgttgacttcccatttgagtcatgtcgttacataggttaacagaatttttttacgacgttcatgttccgtttatctgctctgttaggacaaaacaatgtcgtttattgtagagacaaacaacatcgtttcttctgttgaaacaaatttaaaccctaaatccccaaatcgatttcattatctcaaatcctatagaggccgaatcgattcgaatcccatctggtgaggagacgaacaatgttcctcagcccaaatcaaatcgaaagaagagaaaacggaagaaggaagttgaagtagacgacgtcgttttgttaacctacttaacgacatgactgaaatggcaagtcaacaataactttgttattaatttcgaaaatcaacaaaaactttacgatttatttgtctttcgtgaagttcaagattaaatcgtcccaaatttgaaagttggtgattttttcgacgtttttcccataaaggaatgttgttttatcttaaaggttgcgagttcaattcctgaacttgtaataaaaaattagattcaaaacaacgttgtttcataagttaacggaatttataacagaagacttaactctgttaatttttccgtcaattgacttaacatcgtgcccaaattggcaaaatcgataaaagttatctaattaattctaaagtcaacaataactttggtatttaattgatatttcgaaaattcatgcttttttgtcccaaatttgaaagttcgcgatttttttgacatttttcccctttttatccttcctattatgattgaatggattgtaggaccgcgaaatcctgatttgcaataaatcaaaaatctttataaaacgattaggaaagacgtttttcgaaaacgagtgaagacgagatttgatctctttccataattcaaactagctcccgcagtgtgacggttttatgagcagtggatcgcagaatacaatcactataaaaccggtatcgcagcactcgatagcggaatctgcgaacatgaaataaacgatatactcttgacttactttgagaagaaagggagaaagggagagagtttcgttttagcttttagcaaaaaaaacgagtgagtacaatgagaggaagatgtgttccttttataggagagaggtgaggaaatgcaatccgcaaatcaaagatcgtgggattcggagtgatgcgcaagtcaaagacgtgggcatgattagcggagccattatcacaaccgtttaaggaattaagattcgaataaggaatattcggatatgcttttaatattccgaatataccttagttatggaaacgatatgggctttcgttttgggccaaaaactatgttgcaaatattacaaataatgcaacaaagcctcataagtattttccccaaaaagaacattgtttgtgggccaaaggccccatttcccaagagcccaaggcccaagcccggctcggcacggcacgacggcggcggagcgtgtgtgtgtgttgttttgcataaaggacttgcatctcctacaccatagtgtcccttcccaatagctagtgaaccatgttaaatgggtagcaccatatatgctagaggagagatcttaaaacttctaatatgggacaattgtcaatatttgttattataagctttcaagctcaccactttggacctcaattactcattcataataacttcaatttttatatgtaactacactatcttatagtgctcattacaaggaattcaaagactccataatccggtcattccggtgatggccatcaccggaaaaatcaccgaagagttagccggagccacttgtgtaaaattgagttccaacaatcccccacatgaataaaattgactctaaacatttgagacttttgactgactcgataacctaaactgacttagactttacagactcaactttcaagagtatatgcaaaaaatagatgtgtatgagatagtagtatttttcagccttaaactattcactgttaatatttgtcgaatttacttggccaggaggtgaacatgatgtctttaaccacccagatttttatgtaaacctagacaacaggtaaaacccaactactttttctcgtaaaaacaagttctctagattgtgttcattttggctttgaacaatcctggatttcatgagtgaacttagagaatatagcctctcattctcctagaaacggccacattccacactcactaggtgatttgtcactagcatttgttttaagaagtctcttgtaaaactccacttatatatcaaagctttggactcaatcattaaaagcattgcttatcctttatatgtacaagaagcactgtttatcatcctggaaactaggctgcgactagtaatcttataattctccaaatatatttcgtttgatttagttttcccttttgaacctagttcttgggatctccagtcatataggtggggtatccatcaaagtgacatctttaattcataggctttaaacccattcctcttgatgattgaatcacttgatctcgtgtcaaacccttggtaaatagatccgctaggttgtcgaccgacttaatgtaatcgatcgtcattacaccgctaaaatcaagtgtctaatggttttatttcgtcttctaatatgacgagactttccattatagtgggtattctgtgctcgggcaatagtcgattaactttcacagtgtacacgtaaagctggcacgggtttcccccacattggaatatcttccaaaaagttttgaagccaatcagcttcttcggcagctttgcctagagctataaactcagactccatcgttgagcgtgccattaaagtttgtttctgtgatttccaagaaactgttgcaccacctagagtaaagacatatccacttgtggatttcgagtttctggaatcatctatccaattggcatcgctatatccttccaaaactgctggttctttaccgtagtgcaagccataactttttgtatctttaatagttgggagattaactgtgatgggtaagaaattaggggggtgttattcgttaatggattttaatagaattgaaatccaagccgaatccactgttattcaactaatgattctatatccaactttaaaatttagtgttattggaactcatctttgtaaatcatgtttaatagattttaaagtttgatgttattcaattaagattttaaatatttcattaaaatccagcgttattaaaaactaaaagacttgtaaaatatttgtatattaattcatttgaaatgaaacctctttagagtttcatgagtaaatcactagaatcaaaatccaagacatattgcagagattttgaaattcatacaaacatattcttaaaagcaatatcagaaaacaagtctaaagcttaggtggtgttattcaattattactagaacacgacagaactttttttaattactgttatattttcgacttttttttattacccaacgtgcctctactaaacgttaccggaaaaaacgtaattacaggtaatgccactgccacgtcagaatttactgacgtggattaaatgaactcagccttaactcaatataacggcagttacggttgagttacggtatgttgcggctgacttacgacaaaatatatgattcataacaaaacggcgaagtatgagtataactcagccagacgttacggctgagttgtaaaatgttacctgagttatagtataactcaggcaacggtatggttgagttaaggatggtcggccgagttataagaagttatacgataacccagccaacactatggctgagttatgagaaaaaggctgacttattacctcgacacggccgagttatagttttgaacggcttagttatggaacgatgtgacggctgatttatggtcgagtgttataaatcagccgctaatagctcgattacgatataactcagccttgttatggctgacttattttcaagagattaattactataatatcatgcagttatggtcgtgttgttgaacgttacggttgagttagttgagttacgacataccacggctgaattaactttgttttttttcctgttttaattactgtaatagtattcatgttgcggctgacttaaagatttgcttcatggctgtgttatgaactgttcgtttggtggctgacttgccacgtcatcacttcaaaacgacgttggctgtaataatccatgtcatcattccatgtcagcatcctcgacggaaatacaaaacgtcccttgcttctttaacttgttttcccagactgtgttcaccgcctgaacgttacaacatcaccggaactttcttttcttcattcatcttctcatacatcttcaatttctttcatctttctcttgatatggttggtcccgttacggtcatagttgtttccggttcgtgggtaaagaaatagagattcgtatttaaccccgacgaaagaaggtgtagagttgtgcagttagaagcggaaagaccagtttacgatagtcttttgaagatggaggtcgatgattacagattgaatcagtcgacccatcagttacggctgagttacatgttctccaacaagactcttaaaaatatgcccttcgatactccaccagtttatatctccaatgatcgatagttgcaatgttatctaggtttgacgaaattcgagcagctacgtccctgtgtggagtttacggcgaaagattcaagtgatattagtcagaaggccagatcaagaggaaggggttcgaaacgccctattgaatctaactcaagagtagaatctagattcgaagttccgggttgggggtttgaaggtgtctgttacgattatcaagaggatgaagcaggggacgatgaagcaggggaagatgaatcaggtgtcgatgaagcatctgacaaagaagcaagtgacgaagaagaagatcatgaattttctagccggtttgattttttcgacaactccgatggtgcctcatctgatgatgaagactttgctgtatacggcaagcctaagaataaagacgaagattcaccgaaaccttctccttcgaagagaactcagaccatggaaatgatcggatctgctgggagcctgactgatttaaagttggagctgtctatgctaacactcgcggtacggcaacaatacgtagcaaattcgagttggagtatcgactcaaacttcttgcgataagggatggatttgattttgatgtaccaacttctaataagactacagtaccttacgagtgctgggtggatagatgtctttggagggttcgtgcatctagacaaggaaatgatcctaattttcatgtttatatatacgattcggaacacacatgttctgtgacggaacgttctggtcgatcccgacaagcaacacctgatattctgggagttctttacagggactatcttggtgacgttggtccggatgttaaaccaaaaacagtcggaataatcatcactaagcattttcgagtaaaggtaattacaatgtttcgactgacttagtatttatctgttggctgacttataaatattttacggttgacttattgatatagtatggctgacatataattacattccggttgagttatgactttaaaggctgacttaagatcacttagtggctgagttgtggaatagtgtgactgcgttgtaaatatattatggttgacttatcgattaatatgtttgtgttaacagatgagttattcgaagtcatacaagacgctcaggtttgcaagggagttcactctgggaacccctgatagtagttttgaagaactgccttcaactatatgttcattgcatttggtgccagtatcgttgggtttcattacatgcgcagagttgttgttgtcgacggtaccgctggtaatatgggagaagccgtttttataggcgtattataccgctggtaattgggctggatataaccgtaactcggttagtcagtaaatcgaattgaacttcatgtttttatggacaactcagccgtaatatgttttaaatcagccataacaaggacgatttgtcgccaaactcagctgtaacatgcaacctttcgtattccttgccttgtcttttttaataattcctgacaactcagccgtaacattgttacatgtcttgagtgtaactcagccgtaacgaatatattttgccgccaaacacagccgtagcacggaatattttcccgcctaacacggaacctttcacattcctttacctgtcctttttaataattcttcacaactcagccgtataatagttacatgtcttgggtataactcagtcgtaacaatatattttgccgccaaactcagccgtagtacggaaaattttcccgccaaacgaacagacacggaacctttcgcattcctctacctgtcttttcttttctatatatcagttacttgaactcatcatttagacgtctcatcctcacatcttaacgacatggtgcctcacatcgacggacagtttctaagagatgtcgaagccgtgctcaccgctcctgatcgtgcagatctcccagttctaaaccctggattgggtacatgttacgtggttcaaattcaatcaccaactagctctcgcgattggtgatatactccagcgcaactttcaccatgcgtggccgacgtaccggttgattcccgttgttttcaaggcaagatgggttttcctcctcacggtaagcatcgagtttttatataaagcacttcctgtaaaccgtagaccaaattcttactatttgctctctttgtagcatatgcacacctgggattcaaggcacacgctgacggtgtggacgcagtttaatttggtggctagaacattgtaccgggacaacatgcggacactgaaacggggatgggcgcatggtttagataagctgtggtggatgacgacattagtttggaatgatttggtggacatgtttactgaatttggcccagatgatgtcggtttcatgtcttgaatgcttttgtgtctcttacttatcgtccctttatctcattcctatgaactcagtatgttactttttttttttttttggtgatggctttatatctcatattatctacgatcgccttctcagtaaagtcagttgttatcgcttgaggttacttgttaaattttatcataactcagtcatagcgtatgattaactcagtcatagcgtataattaactcatccacaacatggcggacaatttcggccaactgtctacaaccacttcgtatgtaccatcttcgacccatttaaacaaatggtcctgcatattcaatcacatccgcaattaacaacgaaaccaataaaaccctcaaatcaattatatacttacatctttacacgtaggacaacagaagtatggtcttccagggttctttgctgacgtcgatgtatagatgaccacgtctaatccgcaatgacactttgatggtaacccacgtccccaacggctgatggattgcgtactcgcaatcgatttctcggaattgctactcatttctttaatttttagctgggaaattcagagacgaaaaacaagaaggagctccggatctgaaatcagaaattggaattttataacttagggtttcgttttggggatttataagtgtgtccatgttcatttggtttttgtcacaacgacgatgtatctggtcaataacggagactctgtaacaaacctacgtcgtatctggtcaatagcggagaatatttttctctgcattctgacataactcagccacaatataggaataactcagccatcactttgttataactcggccaaaccctgaaagtgcttttcttgagccaacagtggtgaaaatcaagtaattaacatatcataaccacattccaactagtggaaccgtgaaactagctcatcctattattccttatccaacatcatactttgtccaacatcatactttgtccaacatcatacttcatagaagttttgacaaaccatgttttgtcaatcgacacttgctgaaaataaaagttattttttgttttcaaattgcacatcttcacgctactaatataaccaacaatttggtggctgttttgatatatcataataacatatggtatctcataactcggccaaatcacgaaattttattgcataactcagccgtaacgttttaatattccacgtcgaaacagaaaatttgattattggagggtttagttaaggaataatttcgaactcgtttgaattatcatctattgacgtgttcgtgtgaatatgaaaccaatcattattcgcggtccctattaagacttttttttttaatctcgagaataacataataattgtttctcgataaactcagcaaaagcaaaacacagcaatattctgactgatttgaggacatcaatcgaaccaacaataatgcttgtattcaaatctcataataacatttggttttctcgtatgtagttcgaacaatcgaaatcttctaacataactcagccacatcacatgcataactcagccatcactttgttataactcggccaaaccctgaaagtgtttttcttgagccaatagttgtgaaaatcaagtaattaacacatcataaccaaatttcaactagtggaatcgtgaaactagatcatatcctataaactttatccaacagcctactttgtccaacatcatactctatccaacaacatacttcctagaggttttgacagactatgttttgtcaatcgacacttgctgaaaataaaagttattttctgttttcaaattacacatcttcacgctactaatataaccaacaatttggtggctggtttgatatatcataataacatatggtatctcataactcagccaaatcatgaaatcttattgcataactcagccgtaacgttatttgattattggagggtttagttaaggaataatttcgacctcgtttgaattattttgaatattaactgcgggcgtgtatacctgtgtatgtggatcaaatcattattggcggttccccataaagatgttgtttgttatctcgataatgatataataaataatcttgataaacccaacctaaagcaacacgctaagtagtaacatactgtatgacgacataactcagccacaaatcagtgaaaacccagccgcaatgctatgacaagtcagccacttctaaatttattcagccaatacaagacgccgtcgtttaattagtacattttgtggcagacacgactatatagaaccagtgctttagtaccatactaattgcagtgaagatgatggctcagaggtctcttttccaaggtgaatctagtgttgatgaggtatttatctccacatttgaatagtacaaatcgttacccatctaacgttgagtatatcatgtttgtattaatgtagaagctcgacacttgctgaaataaggatacgaacgaggtacggcaaaaacaggaggggcgataagggcgttccgatcgagtgtgattgcaatgctaaggttgtcgttgccacttctcttgatcctgttacaaccagattttttttttccagttgtccgtacgaaatatcagatgtaagcatcttttcttgagttaatgttctttattttatttctttcattttgtatccctatgaatcaacctcctgttttttttataagggtcccggtcaaggatgcggtttcaagagatggtagactgttgcattgtgtgacgagtttgacatgataaaagaggagacgactgagatgaagaaggatgtggaagcaaccaataagcgcgtcgagtctcaggcagaaaagatctttcttatggaaaagaagtttgaaacgctagagaagatgtatgagagcttgaacaagtatctgtgatgttagcttaatctgtttttctcaatttgaacttctttgtactgtcaattatcattaagtcacaacgtactatcggattaaatttataataactcggccgttacattagactaactcatccacaactcaatactatctcaaccaacgttgaattaaaatatattaacccagccgtaacgttagattcactcaaccatacatcaagttaatctacgataagtccgccttaacgttagaataacatagccacgtcacatgtttaactcagctaaacatcaagttaatctacgataatctgaaagacaaagtttttgaatcacacacgcgagtataaaataaaaagtgaagtttgaaaattgaaaagacagagtttatgataacataggataaggagtactggaatccaataacatacatataatataattgaaaataaaaaatgaagatacaatcacatcaatcgccatcttcattcttcatcggactccgaaattggacgcccggtcgatccataccccagtttctcccaatcaatactattcaccgggcgttcacgctgctctctgtaggccttgccaacctgctccagcactttctcgatctcctcctccacgttaaatccgtcccccatcctctgcactctccttaagagcttaagttccgcttccttctcacgcagtttgagatcgagcaagtgtgcttccgccgtctcccttatgttgctcctgatgtaagagatgacggatttgaaacgcttttcctgttcatacagctttagggtggaaatgtcatccacagacggccacttgttgggaccgtcatccacacaccgccgcttgtttgaacctgaacctgatgcatccatgatctcggaatggttttgtttctcagagaaaggacaagagaagaatgaagagttgtagttgctaagaatcgacaagtgaaaagacaagaggaaaccagtgtatatatagtcctctaacgacgtttggtcctctaacgtaaagacgtttggtcctctaacgacgtttgggttcttgactattctggtgtcgtaaagcggtgtatgtatagtcctaaagtgacgtctagtttatttgatgggagggaagtttgggtttgacaagtcaaccaccacgttatacaaactcagccatcaaacgatttgtgtgatgacaagtcagccaccgcgttataataactcagctaaacatcgaattaaacaacaataactcagccgtgtagcacaatttgagcaatgataactcagccttcacgttagcatatatcagccgtaaaacgaatcgagcgatgataagtcagccattacattggtttttgttataattaacataataatagattcatacagacataattcttgttatcaatcatagtgtcaatatttagtacaatcacatgctaaaatcccaaaagacacagacatgttcgaaaaagcaaatcatgtctcaaaaaactgaatgggcattctatgaggtagttcatcgtagatctctgttgccattctaacccgtagcccctggatatttaaatcagtaatgccatcaaaagaaacaccaatcaataaacattcaaaaatctttaacctgtaaacgctgcagtccccggtgataatattctgcgggacctttgtaatgttcctccgctggaatgaaaattggtcatattgcggggcacggacttcgggagggataagttcgctcatgatctgtggtatcatcctcgtgaacggcctatagtgttccaggatttttccatcgcttttctttgtatgacatccgatgatgcaatcatagcagtccacgtgacacttaggcaagtccacgtgaagggccacccaatgattacctccggtttggaggatagtatacaagtgatccacatctgttatccacttcttgtttgtcgggtcttctccagtcgtaccgttgatccaaccttcatacgcggttcctttgaaagaaaccctcttcggcttcatcgtccactgtgtgtaatccctaacccacattgacgtgaaccacatgtctagaatcatgacgcgttcgctgtagtatggggtgggacaggagcctcttggtgaggattttcacatacgcagcaatgtgctgtacaaaaataaaaccaagacaaaacacaacattaactcagccgtaaccaagtaaaactcagccttaacacctaaataaatctgccattagctaaattaactcagatagaacgacacaataactcagccataaccttagacaaactcagacagaatataacaataacttacatcataagtcagccattatctactttaactcagacagaacgacacgataactcagccataacattagccaaactcagacagaatataacaataacttacatcatcacccagccatccatgtttctcgtctggccagtcctttctttcggccatgataacagagtagaacagcacctcgtccatcccatattccaaatattgtttgctaacaaatagtaaagaaagttaatataaacaaatagtgtaagcatgtcgtatttatcaacttagtaaggtataaagggccataccattcgggacttgtcaaataagccttaagcttctgcagtttggccggatcaaccggtgccagaggatcatagattgctcgtgaaggcagacaaccctttctcatgcagctcagcccgttgtctccaataactggagaagtgtgagtgggcatagcttcggggttaatcaatgacctcccatccggggccagcttaacagttttgagccgaatttcttttacactctttagcctctcggtttcctcctcatcttcatcagactcaggaagcatttcattatactcggatacaaccttatccgtgacatcaactacatccgaatcttcctcagctttttccttagcttcctgagatggttttagtttctttattgtaatctttggcatagtaggagacacctttttaggctgctgcgaaggctttcttcctcttctccctggcggtttctggattagctcatttaatgttttctcctttttctactttggcacatttggggctggtggcttcctagagcgtaaacggcggttgagaggagaagcagtctcaacgaaatcaaaatcagacacaatggataccttagcaaattctcattcaagattcctacttaccccaacatcagcttgtttcgactgcataaacgtaacgaaaactcaggcgttaaataacgaaaactcatacctatgtataaatataactcagtcgtataatatgaagataactcagctataactaactaaactcagccgtatcatattcatataactcagccataactaactaaactcagccgtatcatattcatataactcagccataactaattaaatttaaaactcagccgtatagtattcatataactcagccataactaactaaatttataactcagccgtataatatgaaaacaactcagccataactaacaagcgtttataactcagccgtaaaatattcagataactcagccgtataattcagataactcagccataactaactaaaagttataacgcaaccgaataatattcagataactcggtcataactaactaaaagtttaccggaggaggactaggagtagcaaattggttatttgtaggtttctttggaacgtctggtgtctgttgagtttggaccttaggattgtcttgctgcgtttggggctgtgttttggctaaatacatatctctaatataactgcttgattttgagtcagctatggccttcagctgctctttaatctgtttgacatcgttctcaatcgatccaaaccttccttcaaactttgcttcaaccctcgattcgatttgacctccaatcacatccagacgggaggacatttctttgatgctagtatcaacggtgtcaaaccttgagtttaagggagagatcaagttggacaccacatccacgagcgactgctgttctcccttaccatcctgcttacgagaatgaacatcctcgtcctcatcagattcgacagctacttccttcttcttattcttcttcttcttcttcttttctacatctttctcacgagaatgaacatcctcactgtgagagaccttctgcttctttgcgggagattcagacacctccgcttctttatcttttacgagtttcttcttcttctcactcgtcttcacatcccaataacctttaacaagcttaagctcgtgtaagtcttggatcaagttatccagtgctgggtcttctaattggtctggccaaaaatgaaacagctcgcttaactcagccttttgaaccattgtacgaacacacagctacaacacaagagataataaaacccatgagtatgtttaactcacccatcacttaagataactcagtcgtcacttaagctaactcagccattacagaacatatctcagtcgtcacttaatataactcagccattatagaacataactcggtcgtcacataacatatttgccaaaaaaaagagaacataactcagccttcacagaaaataactcagccttcacataacatacttgacaaaaaaacaaaacattaactaagccgtaacataaatatttgataaaaaacagaacataacagagccgaaaccgtacctcaccaccattccctttgatatcttcagtaatggccgattctatagttgcacgggtacggttgccaccccatctaagcaacggaatctcatccgctttaacaacgttcccaaaacgctcggcgatggtgatgattgaatcatacgcccaagcctgcaacacaaaaaccagaccactgacggtgtacgtcttgccaataggcctcaacaactttatagaaacgacaagggcttcaaatgctgcccgaccccatggataagtcttcatggcttcgtcatcgaaaactcttttggcactctcaaatggtatcctagagtttgtatgcaagccataaagtccaatggatagaagagtcaataacccaaaccatctacgcttttcagaaagccaagctctgcacattactaagccatgcctaagttcatctagattaggaccttcaccggttggcacacgcaattccctgaagaacgctttgtagtcagcttcaggctcaaacttttctgtaggcagttgatctatatttaaacccgtgatatgatgaaattcgttcaatccaaaccggttgggttgaccagccacgatacaccaaagctccttcttcagtattctcagttgtctgcatagtagataatgtacagtcttaccagaccatagaaaatgactatcaacaaacttagcaattaatccaagctgtgtctctttcagttcttcccatatatcttttcctattgattctctaattgcagggaactctcccagctttatgttgtgattaatgcctttaccctccagattagaatccccctcttggtaaagtcttggagggtactcccttgcttggtcttcaaacatctgtataacgataaatcagccgtaagcattccataactcagccataacataaaacaaactcatccacatataccataactcaggctaaaacataaatctaactcagccatagataacataactccgtcataacataaacctatctcagccacacataacataactcagccataagataaatctaactcagccatatcttaacaaaaacttagtcaaaccataacataacaacagcttagttaaaacataaaccagactcagctatatcaaaacagaaactcagccataacataaacaaactcagccgtcatataacagaaactcagtcatcaatgtaaggttaaaccataactcagtcacagcataaaacaaactcagacacagatgaattgataaatcataaatcagtcggcaaacaaacagtaactcagccgtcaaatcaaatagatctaagaaatcggccaccatatgtcaatcaacgacgacgttaaaaccgagctttaaaaaccatcgttaagcatcaaataacgatttcagtgacgggaatcacttgcgattgaacttagatgtcagagtcttgtcggaaaattcgaaataaagtttggaatcatacttaccggaacttagccagaaacaagaaatgcgactccagatgtcggaagtgacttcgcgaaaccagaaattagactccggcgtaagagttcgttccccgtcgagagagaaagaaagagacagtttttttttttttcgccgatgaacagtaagaaactgaaacgtttgtgcgttttgtgatgattaatgacgtggattatgttaatgacatggaatgatgacatgtataatcactgttttttcatttaagttttagttaaaaacgaattaaattataataattaattaaaactaattaggggtgttaattgtaattacacaattactgaaaacatctgagtaataaaaaaaagatctgttctattctaggaataaacatacaagtgtgttctatcttaagaattatttctaaataatttaacactcttgttatgcctttccagtatgtatgacctggattactggtgtagcgacttaatacatttactgcatgcgctaaatcgggtcttgtacaatttgttaggtacataagacttccgataacccttgcatactcaatctgtgatacagcttcatccgaactatttctcaagtgaagttgacaatctacaggagtttttgcagttccttttgagtagtttttaaaccgctttaatatcttttcagcataatgtgcttaagacagagttattccttcagtagttcttgtgattttaatccctagaataacatctgctaaacccatatctttcatgtcaaattgactatgaagcatatttttggtttgttgaattatatcttcagtgctaccgaggatgagcatgtcatctacatatagacataataaaacatatgcattacgagtacttttaacgtcaatgcacttgtcgcattcattaatgctgaaaccatttgacatcattacactgtcaaatttttcatgccactgtttaggaggttgttttagttcatatagtgacttcacaagtttatagacattgtgttcttgtcctgggactacaaacctttcgggttgtttcatatacaatagaacctctataaattattactctataaattaataacctctataaattaataaatgtcccgagttaggatcagtgtaaaaagtaatacaaatcgataaattaataagattataatttttctgaaagtcctatgtaaatatatggtcccatcaatatcataaattaataattgtataattttatttattatatatatgtaaaacattctttaaatatatttataataatttgcttaaattcatatttgttctttgtttgactatattttttatattttactgtatcaaaaattttggtgttgttttctaaacattattattatgttttacttgtaactcgttctagaaaacatttttctataatgaaagaaatcttatagaaatttttcaaaagttactatattaggaaaatttctctataaattaataaatattaatttatcgataaattaatacctctctaaattaataaaattttacagtcccaacattattaatttatagaggttttactgtaaatttattcttctaaatctccatatagaaaagctattttacatccatttgatggatttccaggtctcttaacgctgctattccgattagcattctgattgacgttatcctcgaaacaggagaataggtgtcaaagaaatccagaccttctttttgccggaatctttgtaccacaaatctagccttgtacttatcaacagagctatcggtttttgtttttgttttgaagattcatctacaacctagtgatttaaactcttcaggtaaatcattactctcagttgcacaatacgtcaagatcaaccaatccctttaacattcattaagttcaggaacatgaatcaagatatgcatcgctagtgaactcacttggctaaagacgggttatgagacaaagatggtccctttaaggtggttcagactttaataacaagagactatcaataaaaaagactgagctttagaagaatgctaaaggtaagtgccaacctattaatacaagaatagcacctcatctacccaatgacataaaccatgaataacaagtggatggtcctatctctaaacccaatgatgatcctaagtctaccattttccactaaaggcatatttcaattttttttcttggatcaactcattttctttcatttctttgccccttgatcttaaggagaagcttttcgtaaactctatgagtctagtctagtgaattgagtttttcttaaactctaatggctctatgattttttttcttttttttttctgtttttgctgccattttttctagagtatatcttatcaattctatgcttcccaaacattcactagacctcaatatgattttcagcttccttctcctaaagattttaacccgttttctttctttttcttttcatactcaatctcaatccccaaataagttcccatctagtcctaccaagtccgaaaacgcggattagaactacacggggtactactcttttcggctcaaacctaacacgttataccaagctcaatcctgaaaataggtctcacatgctctcaccaataacatggcttgaaagaagggttgattaatggtggaggaactactccaataaaagaagcagctacttggataagcaagagttgtgaataaatgaaaaaaaatccaaatatgtattctatccatgagttcaaaaccgatgcaaacatgataattataagtcagattcaagttcaaattgacaggaaaaggtgtcatgacatgcaacgagtggtttctatagaacatggtgcggttttacttcaaagtcattcaaatgcatcagagaactaataactcatttagtgaatcatcatgcttacaaggttacctcctcattatcccctatgcatatacaacaagcctaaatgaaacactctagactcgatcctaaatgtaatgcaactacatgaacactctgtttttgtgaaatctttttctgaattttttcaaaaacattttggtttttctacgccttagatgaatgcagattcaagagtatatacaatgcaacacacacttcctgagccctcccccaaacttaaatcacacaatcctctgtgtgaccaaatttggaagagagtactcaggaaaaaacacatcacaaaaacaaagtataaacaagagatggtatagtacaatggtgaagcgagacgcttacctcagtcgaagaatgaacgagttggtcgtcaatggctgcatgtgattgctcccaggccattgaagagtcgacatgttctatctaagctccagcatgtgggtactcaacctcattgcctctatggcggccaacaccgccatgagtatactcaatctcccttcttctgctgcggccagcaccacggttatctccctcaattatgcgtgtgacctcaggactggggagaaggatgttagctttcttgtctgtagagtgctcaaacttgaaacaatgcatgttgccgatcatttcaaattcaaggatttcgcagtggcgcagatgctcgagatccattgctcgtggctcaagtccatcagatgtgattgggactccataagcgatcagaatcgatgtcacaacccctcctatgcaaagagtgtctcgtgctctcttgtggttattggtgacaccccagctattgtatccacacaggtagatcagaagaagtatagagagaggtgtgtcattggtttctccttggagagacatatttttcttggtttggcggagagtgcctttgagagccatagcgatcatctccatatcagaattggtgacagttcatgttatctctcgggagtagaggacattggctacagaacgctggaagtacctgatgataggattgcgtttctgattgctcttagatctagtagaattcagcggtacagagctgccaatggtgatccataaatccttcaattattctctgtcaaacttggacttagtttccgttccactggcgaaaccaaacaatcattccaagcgcttgattgatatcatacaatcctgaccttacacaaagaatctcaagaatctcaatccttcactttccaaatcatcagaggtcataacttggtaaagctccacttgtagtgtggagaggaactgaatcgtttattcctcataggctacatatgggtaaaccatcagagtgtccaggtgacaactctggtacatgtgctgaacatcctccagtaatccaagctgtgccagcgtagtcgagcatggatatcttgtgctgcaggactcattcagcttgaagagcctgatatactcctcagctgggaatacatcaggcttgtgcagaagttttgtggctctgtgagaatgttcaggcatatactcgacctccaactcttcgtctatcagctcatacctctctatcactcctctcttccctcgagctatctcaactcttctcctgaaattttcatattctctttatattctttccgatcttgaagacgaagactcagcctcatccatgtgatagtcaagatccattgacgaaccatcattgtaattgctcatgatagtcctgaaaaatatttagaattcaaatttcaaacgttaataggttagtcttagagaaaaccacaaaactggaattgttcttaaaaggcaacgaaatggaccagtgtggtcgagtaaacctggtactcagtcgagtatggtaactcttgttacttaagatatctttcacgatgtgaatcgagtagcagagagcagtggtcgagtaaaccttgtgagatcgagtggtttttctcgacgaaagcaccgaggatcgagtatctcttcagtgaaccggaattaacagacctgaaaccttgaattgatggtcgagtgtgttcttgaggtttcgtcggcttcgaggtgatgaacggacttgcagatagagttagactgcagttactcgacggagagctcgacgacggtgcagaggtcgagtacagtggttgaaaccgaataacggagatggtgaacttgctaaaagtggtgaggcggtcgagtctactggatgaaatcgagtgattcttgaggtttcggcggctaaacttattctacttaatggtgaatgagacggtgaactcgattgcggaggcgtagcagtggtcgagtatctttggacgtcaaggtcgagtatctttggatgagagagagatggcgttttgtggtgaaggagagagattggagtgtcggtggtggaagatgaagagagatgggaggtaacttttagtgtttggagatgaggaaagcaatttcaaaaggtgtggtggagaatgaatttgtaattctctctccatcttatcctcaaggagaaaacgcgtgtggtccaccctctgttgacttgtctttaagctctgttccctgttgactggataaacctcagtaatcctaaaatcctttgtaaatttcttttggtcgagtataatgtttaatcgtttgatcgaaacaacattatactcgatttccaccggtggtctccacatttcttatgttggtcgagtacttggtcgagtatgaaggctcagttatcaaacttactcgaccacatttcctcatcagcatgtggttagtgtgatcgagtgacatgttgaagctccaactgaaacactcgatctctacagcatgtggtcgagtgactctttgaggttgaatccattacacttaaacatttgcagttatctcctgaaaacactagtaaaatgcatcaaaaataacaaggaaaacaaaaatatatacagagaaaggcatgggacttcttcccaagtgagcttgttttaagtcgttagtttgactaccttactcctttaatcatcaagaggttcctggagatgaacagaagtcacctttggaaggatttgatcttctaagtatttcttgagcctttgaccatttactgtgaaatctccactcttaacagctagagtgactgctccataaggacggatttcagtgacacagaagggaccaaacaatctagacttaagctttcctgtaaagagtttcaagcgagagttgaatagcagcacctgatcaccaacctagaaatccttggtgatgatcttcttgtaatggaaaagtttacttttccccttgtagtttttagagctctcataagcttctaaacgaatctcatcaaggtcattgagttggatcaaccgctcctcctcagcggtttttatgtcgaagttcatgagtttaaccgcccacatagctttgaactcgagctcaataggcaggtgacctgattttgcatagagaagattgaatggtgttgtaccaatgggggtcttgaaggcggtcttgaaggcggtcttgtaagcccacaatgcgtcatcgagctttgcagacaagtcttttcttgtaaccccaacagttttttccagaattgcttttatctccctgttggagatctcaacctgcccacttgtctgtggatgataagaagtggcgaccttgtgctttactccatgcttcttcaagaggttctcaaaagctttgttgatgaaatgttttctaccatcactgattactaccatgtgaactccaaatctcgtgaagattatggtcttgaacagcttcaacacaacttttgcatcgttagtaggactgacaatagcttcgacccactttgatacataatctacggcgaccagtatatacttgttaccgtatgaagatgggaatgaacccatattattgattccccatacattaaagatctccacttacaagattggtttttgaggcatctcattcctcctactgatgttgcccttcctctggcatgaatcacattttaagacaaacttttgagcgtccttaaacattgttgaccaccaaaagcctgtttgcagaatctttgacactgtcttgaatgtcccgaagtggccaccatatgcggagccgtggcaatgtagcatgataccttctacttcatcttctgagacgcatctcctatagatcttatctttacagataatgtaaaggtaaggctcatcccagtagtaatggtgtatatccttgaaaaacttcttcctttcataactggtcaagttggagactctactccgcatgccaaataattgacgtgatcaacataccatggagatttttcctcaacaacattcagttggtggaactttttcccgctgtaactcccaccaaagaattctacaaccatgagttgctcttctcgcattgagtcgtctatcggaaaaggttcttcaattctcatccttgaaagatggtaagatgcaccatctttgcatatagatgcctcaaagctgcatggtctgtatagaccgtgaccttggatccaaccaaataccttctgaacttctcaaatgcgaatataacagctagaagctccttcttagttattgcatatcttcattgagcttcatccaacgtcggctggcgtaatatatgacgtgaagcttcttgcctattctctggcctagtatagctcctacggcataatccgatgcatcgcacataatctcgaatggatagtcccaattaggagctcgaacaacaggagcagataccaaagcttccttgatggtgtgaaaggatttgaggcagtcctcatcgaattcgaactcggtctccttgcataatagtctagttaatggtctggctatcttagagaaatccttaataaacctcctgtagaacccagcatgaccaaggaaacttctaatgtctttgacagtttttggtggctgcaattgcataatcactttgatttttcccttgtcaacctctatacccttctttgatatcttgtgacccaacactatgccttccttcaccatgaaatgacacttttcccaattgagaacaagattagtctctttgcacctggtcaatactctgccaagattcaacaaacatgaggagaaggaagggctatagccgagaaatcgtccatgaagacctccactatctcctcgattaaatccgaaaatatagaggtcatacacctctgaaacgttgcaggagcattgcataaaccaaatgccatctcttataggcaaaagttccataaggacatgtgaaagtggttttctcttgatcattagggtgaattggtatttggaagaaaccactatattcatcaaaaaagcaataatatgggtgattagctaagcgttcaagcatttgatcaatgaatggtaaaggaaaatgatctttcctagatgcaacatttagctttctataatcaatacacatcctatgccaagttatagttctagtctagatcaattcattcttttcatttttaacaacagtcattccaccttttttagggacgcaatgcactagagaaatccaagtactttcagagatagggtatttgacaccagcatcaaccagtttcaaaatttcttttttcactacttctttcaagttaggatttaacctcctctgtggttcaatgctagaatatgatacgtttccaacatggatcctatgattacataaattaggtaaaattcccttaatgtcagataatgaataaccaattgctctactatactttctaagttcagacaatagcaggttaacttcatcatcatttaactcagtattaatgatcacatggtaagtagagtttgaaccaaggaatgtgtacctcagacctttaggaagtggtttgagattaaccttgggtgccttgagttcagaccagtcatttgaagctggaatgatcagctccacagtgtcgctgacggttgcgatcgagtgattggtcgagtatgtcctcgagtgagcaggttgaacctgtgttgacctttcttcactcatcgtcatcacctctgttgttgccccattcaattcctcaaagggttctaactcttccatcgctttatgtgagtctaacaacttctagtagcacaaagtctccagatgcagaaaccgtgttcaccatttttggtcaaagcactattaaggtgatcttaagctcttctagtaactcgtcagctaactgatccatttcttcgatccaaaagagtttcccttctatggtaggcttcttcattgcatctttgacgtcaaaggttatcccaaaatctttgccaaggtttagatcaatcttccctatcttgacatcaatcatagctcctgtaattgctaagaaaggtcttcccaaaatcaaagggtctttgggctcttcatccatctccaggactacaaagttagttggtatctctacagctccaatcctgattggtaggttttcaagtaaaccttgagggatccttactgacatgtcagctatgataagggatatgtggcaagatttgtatttagtgaaccccaatcttttggcaacggagagtggcatgggactgagtgatgctcataaatcacataggcatctgttgaaagccaatggacttaaagagcatggtaaagtgaatgaaccaggatcactaagcttgttgggaatgatcttcttctgtataatagcacttcattcgtaactcaatactaccattccttgcacttcttgagttctctccacgatcaagtctttcagaaacttgtgggaatccgggattagtgctagaccgtcaacaggaggtatctgcaactcaacctccttgatgttcttggcaaacatagctctatacttatttgccaatgctttcttatgacagccaggaaatggaagctggggtttgtaagggggaggaacaaagacttttctttgttcctgacatcaactggtttcggagctgttggtgatgttactaggaatggtggtcgagtaacatggtcgagtggctgctcaagttgtttgtcagcttgatctttactgagaatgaattcctccctatcttgatatacactatcctaagtgactgtcttaggttcctcttttgttggaagtgcttttctactgcgcatggtgatagctgtaagaatatggagctttaggttgcgagaatgggactcttgattaagagggttgagagtgagaaatgaacataaggaagagatagtattgcggaaatagaagagagattgtgagaaaagatattttctctatttcttgattaaaaacatacatacgatacaagctatatatggacattaggtaagtaaagatctcctaagaatatgctaaacacgtcgcactctatacaagtccacatcgtgtagacaagtcactatcgtactaaagaaagagacatgacctaacattcggtttgctttaaacacatgtgatcttcttttgacttgggcgcttaagcttcaacggctacatgaggagtcttctaggtcttctagaagagcttaaggtgaagaagagtttatatgggcttctctcattgtcatgttgtacggatgggcttctcttcgtccgtacggtcgtctaggttaacttgcggaaggggtttccttcattaggttcaatactccccctcaagcttaaccggagatgagtcgagattaagcttggaaccaaattcaaccacctcattaaaaaccttagtgtagaaaaacctcttgggataaaactacacacaagggaaaaagagtatgggatatttgataagaggatcatggccgggttagatcaactaggccaagtttgttgtgaatatattcacacaccttggtgctcgctcctttggtgaagacgtcggctaattgttcctcaccctcagtgtaatgtggtaggatcactccgagttgtacttgttctcgtactttgtggcaatctacttcaatgtgctttgttctctcgtgaaacaccgagttggaggcaatgtgaatcgcagcttgattgtcgcaatgcattggaatggggtttggtgtatcagtgccaaagtctttaaggagagctttcaaccacatgagttcagtagtgagctttctcatggctctatattcggcttcaacacttgagagagacactactttttgtttcttgcttcttcatgttactaggtttcctccaatgaaggtgcaatagcccgttgtagatcgcctatcttgttgatgtcaggcataatccgcatcacaatatccaacaatctccgtgtttctattgcatcccatccaaatgccttgacccggagctcctttgagatatttgagaatgcgattcaccatgttccaatgatgtattgtgggagcttgcatgtgttgagttactacattaacaacaaaacaaatgccaggtcaggttatggttaagtagataagtttaccaacaagtcttctatatctcgtagcatcttcaaatggtttgttatcatgctccccctttcgtttggccttgtaatcgtcctctagtggagtcttggccggttttaccccgagtttacctacttgggcaagaagatcaagtgtatatttcctttgggataagaagagaccttcctttgatctacaaacttctatcccaaggaaatattttaactcaccaaggtctttaatatcaaaaacacttttaagaaaagtttttgtatcttgaatacctaccttgtcattcccggagatgataatatcatctacatatacgagaatgactactatacctttttggcttggtaaagtgaagagagtgttatcggcttcagaccttttgaaccctcttcccatcaatgtggtgctgagtttgtggtaccacgctctcggagattgctttaaaccgtagatggctttcttaagcttaaagactttattgggagcattaatgtcttctagacccggtggtggcttcatgtacactttttcttcgagttctccttgaagaaacgcatttttaacatccatttgccaaagatcccactcgagattggtcgtcaaggagagtactactcggactgtatgtaactttgcgaccggagcaaacgtatctagatagtcctccccatacgtttgagtaaatcctcttgccacaagtcttgccttgtatctttcaatctccccgtcactcttatatttaatggcgaagacccacttcgaggtgacaactttcttacctctaggaagctcatcttcatcccatgtatggttgttctccattgcttgtttctcggctgcaatagcgtccctccatacttgatgagttatagcttcttcataagtttgagggatccaatgttggtctacttttccaaaaaagacttgatgttcttcgggtagatgagctagggtgcacacaacttgaattgggtgttccacgacattgtcaaagtagacttggttgttgtagtagactctcttgtctttaagatgttcacttcttcttggtattctcggttcttctcgagagttagagtcttcttcttggttattagtatgaccattgtcatcgttaagtaagcttgtatccttctcttgaaccttagaactctccgtttcttcaagagtaattagttcttgttcttttccttgtttttcttcttcttcttcttcttcttcttcttcttcttccatgttctctggttgtgtgatagtctccggatttgaggttcttggtgttgtttgagtctgaatattacttacaccaagtctttcaaggatgatccggagatttgtagctctatccgagggagagtcagtaagatcttgaatatcttcccaattcttcttatcatagtagcttttagactcgagaaacttcacatctctagagataagaacttttcttgtttctagtacataacatttataccccttttgattaatagagtaaccaatgaacatgccttttgtactttttggttgtagcttgttcctttgttctcctgaaataagaacaaagcacacacacccaaatactcgtaagtgattgataaacggtttaactttattaagcacttcaaagggagaagagtctagtaagatcttagttggtgtttggttgattaagtaacacgctgagaccaccccatcaatccaaaaatgttttggaacatttgtatggaacatcatgactcgtctgacctccataaggtgcctattctttctttcagctactccattttgttgtggtgtgtatgggcagcttgtttgatggattattccatgtttgtttagatgttgtttaaaggcatgacttgtgtattcccctctgttatctgaccttaagatttttatcttagcatcataatgattagtcacataagtttgaaagttagtaaaagcttctaggactctatctttagaaggtaataacgtaaaccaagtgaacttcgatttttcatcaatgaaggttacaaaatacttatgattttctctagataagcaaggtgatgtccacacatccgagtgaataagatcaaaacatttctcatagatagtgctagatttgggaaacacggatttgcaatgtttaccaagaatacatgcttcacattcatcatttttaaaagaagtacttggcaacaaaagttttaaagcgcgagagtgaggatgacctagtctagcatgccaactttcactattcgcattaccaagaatggaactaaaatgagaagataagggaacggatggctttgtgtcttcaagaacataaagtccatcctttgtaactccttgaccaagcactctactagtctcaatatcctgaaaatgaacctcattaggaccaaagatagcataacaatttaaatcggttgtagctttcttaacggatagtaagttagaggtgaatgtaggcatatagaaagctttagagcttttatcaaacaaatctagatcacctactcctttaaccggaattctatcaccattagcgattactacatttcctaaagccggttcaatattacttattaacttcgaatcactaatcatatgatgagaagctcccgagtcaataataagaggctttaaagagctaagggcatgataagatttaccggaggactcctttagagccttaatgagagctttgaggtcggaacgcctcactaggtcagaggaagctgccattgctgccccattacctcccaagtgttggtttgatgttccggattgctcttgagttccaaagttctctccggttacttgattcgctcttggttctctccttccgggtcttaggtgagggtgaagtgtccaacatttctcctttgtgtgaccgcttctcttgcaatgttcacaccatagagcctttttgttgttgtcatacttgtaattccctcggttagctgtagcgagatcacttagattgactcaagctagctctcctttgttcccaaataacccgagtgaaccttgttccttttggatttgagagcatacttcctcaagatttgggagcttgtcagctcgaaggaggtgtttgatgagatcattgtaggtagagctcaaagtaaggagaagaccaaacactttatcttgttctctcctttcgattaggacctttggatctagagtgttaggtctcaacatctcaagttcagcccaaagagacctaaactttccaaagtgttgagtgaactccatgtctccttgagaaagatcgttgatggctttctttacttcgaacactcgacttaagttggactggtttccaaacacattgaagagagtttcccatagctccttggcggtctcacaatatgagtaagcttcaagaagggaagcctcaagcgagttttggagtagagctaagactgattggtcctcttggaaccatttttcttcaccgacatgaactatctccatgccttctcttatggtcgcctcggatggtgcttcactcgttaagatgtgagcccaaagtcctcggctgcacaaggttgtcttcgtggttcttgcccacagaaggtagttcactcctttgagtgtaaccggaacaaacaaagctttagtgttctccatggtttagatctgaacggaccggaggataaagcttttaaccgaagagtaaaaggactcgttttattgaagaggaagaagaataagaatgatgtagagtagaatgagtatatggagctttatggctctgataccatgtaagaatatggagctttaggttgcgagaatgggactcttgattaagagggttgagagtgagaaatgaacataaggaagagatagtattgcggaaatagaagagagattgtgagaaaagagattttctctatttcttgattaaaaacatacatacgatacaagctatatatggacattaggtaagtaaagatctcctaagaatatgctaaacacgtcgcactctatacaagaccacatcgtgtagacaaatcactatcgtactaaagaaagagacatgacctaacgtttggtttgctttaaacacatgtgatcttcttttgacgtgggcgcttaagcttcaacggctacatgaggagtcttctaggtcttctagaagagcttaaggtgaagaagagtttatgtgggcttctctcattgtgatgttgtacggatgggcttctcttcgtccgtacggtcgtctaggttaacttgcggaaggggtttccttcattaggttcaataataggatgagcatgtgcatattcttttggattctaaattgattttcctggaagttggcttgactgtttctgagcggaagtagatgcaaaaactccctccaggtatgtgactttggaattcagtgtctccaccttgacatttagatcattgtagctacagtccaccttccatggagccagatgcttgtccttggagtagatgttgtagcatttgtttcatatcagcgttgggagcagcaggacctttgtgttgctgaggtgcaaacccaggtggtgtttgctgctggtagttcccccgaaattgctgcattggatcgaaaccttggttgtagggaacaaaaggtttgttctgaccttgttgttgatgatgtggaggatacacctgatcctgtagattagcaacattggtgctgcggtaggagaggtttgggttattagtcttgaagttgttgtaccctttgtagccaccttgattgttgatgtatttaacttcttctaactggttcccctccccatcttggacttgatactgctcgtcatcaacaaggaagtgcacatgcttctactggctaagaagaatcttgtccagcttgtcattcagcgctttaatctccttcttatgtatgtcatccgagtcagctgttcttctgatggtcctgtcttagttctcgttgtaattttcatctgactgagctaggttctcaaccaatttccagccttcttcaacatctttattctggaaatttccattgctggcggtatctagaagcatttttatccgtggtagaacacctctgtatagagtgctgagcagagaggctttcttgaagtcatgatgaggacattggttaatgtaacccatgaaacgctccaatgcttcacagaagctttcaccagtcttctgtgaaaaaccagagatctcatttttgagtctatcaaattcctctaagtggtcgagtgggtcttccataggcagaccatggaacttgttcctctgaaacatcgagatgagacaactcttaatctcgaagttgttattctggattgcaggaggtgcaattcctttcctctgacggtgatctcgtggtgtatctctggcaccaatgtttgtagggccattttgttgattttgttcatcagccatttttagtggttgttggggtacaaggttgaccatgtttctcctttttcttagttcgagagctatgtggtcgatgttatcgttgtaaaggaggttctggttgccggttgatcgagtttgcatacagcagcagagtggtacctggatcatgaagacaacaagaaaaacacacagttagtaccgggaaatgaaaattgaaaaagaatttgatctacgcaaatctgaaatcttaaatgtaacaaacaaacactcaattggcaacggcgccaaattgataataggtttttagtcaattatcctaaatcactatcatgtcattgtagtaatgaaggttttcaatccaaatgggtgtgatgctaacaatctagatgcaatcagagttcatagagtcaagccaagcaatagcaggtttttagtttcaaacagttctaggtgaacatgcaggaaacagaaattcaagaaaaacagtaaacactcgaccaacacagcttgttatcaactacatggtgtggacgagtgacaggtcgagtaaacagtaaagacagtggtaaagatactcgactgcacagtctgttgccagacaactgcgtggtcgagtatcacagtgataacaggcgaaaaatgcaaaacccaaacaatagccaacaagatgtagtaaacaatagtagagtaaacaatgaaatcaattagatgaggaattcccgaggatggggtaattgagtagtttcgtttcctcagtttacaggtgattgacatgctcaataaactatcctagacaacaagttcgataaccaaatctaagtgccaccgcaacagagatcctcaagttaagctagtctaagactcaatcaccattgacgagaactaacctaacaggcattacaaatcaacaagttaaagccaaaacgctccctgtaaccaataccttggtacaaagccacaaatctctggaattagtggttcatatatttcatcgaacaccttttgggtacggaaatgtctaggctcaaattccagtttatctgaaagcaataggcattaagaacaactaatccagaagggatctataaatccaactcaaccatctagtatactggggattctaaactactctaacccgtccttagaaacctagtcactactcaaacatcattgcagaaaacataaacgatgacaataatgaaaacatgatagcaacaaagtaattgcaagatgataacaggatgatcacaacttagtaaacgcaatgaaaagcaaatactcaatagattaagagaaatccggattccaaaatgtcaagaacttaaactgtctacggaataaaaacttgttctcggaaatgtaaagtacatgctacttatagcgaaatattccgaaatcctaatactcaaaacgacatcgtattgggacggattaagaacggtactcgacccaggtggtcgagtagtgggtcgagtgacaagtcggagtcttcttctctttctcatgctcgaatgtctggttgagtgcggaatcgagaagaatctaaagcgatgatgctttctactcgaccagggggtcgagtggtgaaccagagtgttgcggtcgagggactagctacggaggtcatgaccgagtacttcaagaatgctaggatgacggtactcgagctcgtggtcgagtatggtgatttgatcaggtacacttcttccaattagctcatcagcagctccaaatcacctgaaaacaacacaactatgcaatatgcatgcaaaactgtcctaaacatgcaaagtgatgacaaatgatgagaaatggtataaagcagtggtgataatatgataaagtgatgacaaagggatattcaaaacgagtaaaatgcacacttatcaataacctctgtcccttccattacttctgcaaaatcatcatctaaaattttgaaatccttataaaattttgtagtcccattgtagccattaccactctcttttgcacatgagtatttgaaatccttaattcgaaaactatatattttacttgtataccccaaccgaaatctaatttctattcgatccacacccgacccatctctcccaaacggatatttctttagatattccaagtttcaacatttttctcttcaatttttgaatcttttcgatttctcaaactctctctctctctctctctctctctctctctctctctctctctctctctctctctctctctctctctctctctctctctctctctctctctctctctctctctctctctctctctctctctctctctctctctctctctctctctctctctctctctctctctctctctctctctctccccgtgcgttctcttctccttctcaacatccaataaccctaatctcttttctcagaatcttattgttctcctacttccaaccctaactgcaactgacccccatgccacctttaaagaagaaaacttggttaaagaggaagagatgagtagtaacgaatccaattgatggaggaacaaaagcaacgacagaggagctggcaacgaagcaatcgatggaggaacaaatgcaacgacggaggagctgacaatgacgaaggagccaccattagggttgtcattgaggtcttaaaaccatgtgctttttaataatcgtgttgactccacctgctgattaatgagatgatgattttccgagaaataatctcagcttttgtgaaagaaaaaaaaaagaatcaaacctaatttttggttttcgagttgaaccatgtaaactaggtgatgttcattcttaatgggtcacaaatgctagatataagccctgatgtcttttttaaatcgggataaaccggtacgtttgggtcactcaattcacatgttttagatggttatttgtggttttctatccggttttatctggatcaatatgtttgttgacggtactactctcaagccaatatctcataaacacaaatcaagaactcaaacaaaccataagaaaactcagtagattgttttatttactcttgaaaaagaaacataaacaaaattgggaatttacttttcacataatgaaccaatagcaagtaaaaaacattaccatcatcatctacatatatctccccatcttaattctctatagcaaccctgcatttatcagaagaagcattcctacaaagaacctataaaaacttgtgtagagaatcaaaaatgaaagtaaaaggtcagaccgaggttgtgatatcattgtatttaggacgtggtcgatccgtagatatcacttcttccattgcttttctcttattactactcaacattggttcaagttgttccgattcaacttcttggtggagaggcaaaatgtcaatcactaatgactcttcttctatctccggtttagaaaccacaatctcttctatggcaactggtttctcactttctttctttaactttgttttcatcatatgaggtttcaacttggtatgatcaactaactttactggtttcaagaaaaactcttcagctcctttttccaaacatctgttggaagaaaccaccacaagtttgtgcatagttcaaagacttattcaaaccaaagaatcaaataatacccacttgccaattaaaaaatcaataagactcatattaatgttaaataaacagagctcttacctggagattcttgtaggaacgttctcagatgacattataactacatgtatacttctaaatgctgctgattcctatacacaacaatcatgtaaattaatcagaagaaaataaaactgaagggtttatgttgggcttgtccaaaagctgaccataataaaatggacatcgacagtccatgatttttaatattgaacttatgaagtattcaacttatgtttttaaaaagttcttaatattgaacttatgaagtattgaaattatgtcacgtgtcattgtgttaaacaattaaaacttaagtatgaagttttgaataaatgtattcatgatatccatgtattattttggactcatggacagcccaatttactatggttctttttgaatttggtgtaatttgggtctggtcctatttgggcttagaccaacaatgtccaaaaaatggggttgtaatggacagcccatttgacatccctagccatcatcgacgaagcaaaatccagcaattgagagaggaggagttgaagaaccaatcctgaccataagtccggttttagagtcagtggaacaagagaagtctaacaagaatgaggaagaaatttctgagaaggatgacgaagaagagagtgaataagaagagagtgaagaagaagagaaagaagaagaagggaatcgcgacggaggagagtcctccaatgataacactagattttaacctttttaagcccttgtttttcatgcatttagcttagtttcatgtctcttttcatgcattcttagtctcttttctttcctttgcacattttgcattgcattgcattgcatacttgcatttggagtgttttacaggtgaatcaggtacttttggactcgacttggaggtttctagcacaagggatagacaaactcgatttcgtgggatcaaaggaaggacttggagtatactcggctttcttactcggctggagatcgagtggagcacacaagggagaagcaaagacgttactcggccaagacactcggcttagacccgagtgatgcacttgaggaagaagggaagcttctcgaccaagccactcggcctagacccgagtgatgtgaccaagaggaagccactcgacttttctactcggccaagacccgagtgatgcagcgccgacattcccattttgtcttttccaattagggtatcctaggattgcctataaacagacctcttatgtttttgcccaaaatatctttgcttttatctactggatattagggttcttatatttcttttgcattttctggttgttgtgttgagaatttggatttgatttcttctgcaaacttgtttatcttattaagatctatcattttctaagtttataatgatttatgagttttatgaattttctgggttttgttctatgatgttcttcattgttcttgagtagtcttttcagatttcttgaggatgagttaggtttaggtggattcctctgttctttagctagataagtttataaatgcataattccctactgttttaggagttcttaatgctattttctttctgatcaattgaaaattgatttcaaactttctccacctaaccagtgcttgatgaaatgtctgaaccaactaatttcagagatttgtagattctagcccaagaccttggatgtttagactgcttattgactttaatagattggggtttaaagcctgctttgttaagtttcatcaatgaaaattgagattaggaagtgataaagttatgagagtcattgtcacgaaagtggattgatttggttttgaatctattgtctagggatagcttgattgagtttgttagttagctaatggattgaggagtccactaagaccaattaccccattcttaagagctctgtttcgttttattgtgcaaaactcgtgtttttagtactctgttcgtctcgtgcaaaattggtgtttttagtattgtactcgacctgtttagttgtttgctcgaccgagtgcttgacttagtgattagtttactttctgctcttgctatttgagttctttattttctgcttagtatagttctgtttctgaatttgatttgcatgttaacctgttgcttaggtttagtagaaacacaccaaacctattcactcttggcttaacttagtattctctgatcacatcttgattgatagcaattacacccatttggattgacaccttaaatgatgcaatgacataagatgcatttagggaattaacacaccgaaaacccttgtatcaatttggcgacgttgtcggggattgatagtaggatttttcacatgtgtttaaatccagatgatcaattccctaacactatcatgtcattgtagtatttagggtgttaatccaattaggtgagtttgctatcaatcaagatgcaatcagcatgtactaagtcaagccaagtctagatgaggtgagttatctaacaacctaagtgatcatgaaagaaactaactatactaagcagaaattaaagaacatgagtgataaaagcaagaagtaaactacacaccaagaactctcaatgcataaacttaaaaaatgaactaagtagaggaaagtaaagatgctcgaccgagtatgaacatgcagagagtaaacaggtcgagtaacaaagtcgagcagaataacaaagcagagcgatcagataaactaaactgaacgagcagaagagtaaataacacgaaactcaataaatctaagcgcaacagagctcttaagaatggggtaattggttctaatagactcctcaatccatttagctaactaacaaactcaatcaagctatccctagataatagattctgaaccaaatcaatccactttcgtgacaatgattctcataactctaccacttcctaatctcaattttcattgatgaaacatagtaaagctggctttaaacaccaatctattaaagtcaataagcagtctaaacatccaatgtcttgggttagaatctacaaatctctgaaattagttggttcagacatttcatcaaacacttattaggtggagaaagtctgaaatcaattttcaattgatcagaaagaaaatagcattaagaactcctaaaacagaagggaatcatgtatttataaacttagctagctaaagaacagaggaatccacctaaacctaacccatcctcaagaactcggaagaacactactcatgaatagtgaagaacatcatacaaaacccagaaaatcataaaacccaaaaatcattataaacttagtatgcaatagatctaagcaagataaacaactttgtagaaaaaaattattgtaaaaacttaaagattcaacaggaaattaaaggaacatatttagggttttcacaaaagaggctagaacaaaaggaataaaagaggaatatccattaggtaaagggaaggggtctatttatagcaaatactaggttgttctaattcgctagacgacaaaatagagaggcggtttggtcccactcgacctaaggtcgagtggtttggtcgagctggtgcaaatcttcaatattcatattttcttcacttactcgacacgcaggtcgagtataaaggccgagtacaacacaaatcttcaaaaatggctcctcctgcacattctgttgtaattgttgcagtgccgaaacttctgatgcaccactcgaccttatcccgtgcgtagatctcgagcatagcttcatttcttcgcgtggcatctttttggtttgaattagtattctctgatcacatcctgattgatagcaattacacccatttggattgacaccttaaatgctgcaatgacataagatgcatttagggaattgacacaccgaaaaacccttgtatcaatttggtaccgttgccatttgggtgtttttcttgttacatttaggatttctgagttattaagatcaagttctatttctttctttctggttactcacttggttcttcatttgcttgtttttgtcttgcaggtactcatactcgactagcacatcgagtacatcaaccgagtaagatcaaaacgtatgcaaactcgttctcaaggttctagcaatctcctgtggtatagagacgacatcaacagggttcagcgtgaacttagagaacaacaagccacttcaaacccggtagtaatggctaatgagacaaatgctaatgagttgccagagcaacattggtgctggtgatgcacctagaaaccaccatcagagagctggtattgtcccacctcctattcagaacaacaacttcaagatcaagagtgatcttatctccatgattcaaggcaacaagtttcatggactaccaatggaggacccattggatcatcttgataactttgatagactctgtagtctcaccaagattaatggagttagtgaggaaagcttcaagctcaggttattccctttctcacttggagataaagctcatctttgggaaaagactttgcctgttaaatctatagacacttgggatgattgcaagaaggctttcctagccaagttcttctctaactcaagaaaggctagattaaggagtgagatttcaggattcaatcagaagaattcagaatcattctctgaagcatgggagcgcttcaagggctacaccacccaatgcccgcaccacggtttcaagaaagcctccctcctcagtactctatactgaggtgcttgcccaagattcggatgctcttggatacagcttccaatggtaacatcctcaacaaggatgtagctgaaggttgggaacttgttgaaaacctagcacaatctcatcggaattacaatgaggactatgatcgcactaacagaggcagtagcgattctgaggacaagcacaagaaggagatcaaaactcttaatgataggattgacaaattggtgcttgctcaacagagaaatgtctactacattacagaagaagagcttacacaactccaagatggggaaaatcttactattgaggaggtgagctacctacagaatcaaggtggctacaacaagggattcaacaactacaaaccacctcatcctaatctctcttacagaagtaacaatgtggcaaacccacaagatcaagtctaccccccacagaaccaaccgactcaagctaaaccctttgtaccctacaaccaaggctacaaccaaaagcagaactttggacctccaggcttcacccagcaaccacaacaaccttcagcacaagactcagagatgaagactctacctcaacaacttgtgcaaggacatgcttcatgttccatgaccatggataagaagctagctgagctcaccactaggattgattgctcttataacgacttgaacataaagattgatgcacttaacactagagtcaagagcatggagggacacattgcttctacttcagctcctaagcaccttggacaacttcctggaaaagctgttcaaaatccaaaggagtatgcccatgctatctccacagttaatacttctgccactgaggacagtgggattcaagaaggggaggttttgagaccaagatcaagacaggaaattgaactcgacttctttgctcggcttgtcgaacgagcacatgaccctagcaacccaatccatattccatctccctatgtacctaaaccagcatttccagaaaggattgcacagattgatgaaatgatcttccagaaacacaagatgatgttcatcaagtgtatcaaagagttagaagagaaagtacccttggttgatactcccaaggaaatgattatggaaagaccccaagaagctcagcaaatagttgaattgagttttgagtgcagtgctatcatacaaaagaaggtgataccaaagaagctaggtgatccaggttccttcactctaccttgttcactagcacccttagtgttcaacaatagtctttgtgatttgggagcttcggttagtttgatgtctttgtcttttgcaaagagattgggatttaataagttcaagcctaccagcattcatcttattctagctgatagatcagtgagagtgcctcatgggatgctataagacttaccggtaaagattggatcagtcgagattccaaccgactttgtggttctaaagatggatgaggaaccaaaagaccctctcatccttgggagaccatttctagcaactgcgtgcgctcttatcgacgtacaaatgggtaagatcgatttgaaccttggtaagaatctccatatgaattttgatattgctaagaagatgaagaagcccaccatagaagggcagcttttcttcaatgaagaagaaaatttagaagttgagttgttgagtgggttggaaaattatattccaaactccatttcgactcgccacctaggagagaccaagagcctcttatgatagaaggggaacctagctcagaggttgagactgagaggaactattttgatgttggtcctattgctagagagcttatggaactcagaaaacagtatggagctcaaggggtaaccattgaaaagttggacctcaagatggaagaattgaattatgctatcttgaagcttaaggagatgattaagggttaccccggtcctgagattgagaaatattttgaggaacctgatttgggagaagaggattataccactgatgaaaaggaggcttactttgaggaaagatccaatgaataccctacactccagctatctagagagaatgcggagtatgattcagactttgaggattcagcaagtgaggatgaggacttctcagttcctcttctcaatatcttctctacataaacattgtgagagtcaagcttagtgactttaaacaagctcacttgggaggaagtcccatgactatccttgtatatattgctttcttgttatttttaatatttttgtttaagtgttttagtaaaaagacttctgaaaattttcaggccacactcgaccgtaccactcggctacaaaccgagtgtaggcttcaattgatcaaaggcccaagactgaaccatactcgacccaaaaaactcggcccatggtcgagtatgggcctcactgttaaaaggcccaagaagatgcaccactcggcctgaagccgagtaagaagaagcccatcaggcccaacactgtactcgacacgcgcgtcgagtatgtcggccgagtttacacgtgcgaggtcaagacaattcatatttaaatttgaattcgaattcacttggccccacacatcaaatcctgctccccaaagcccatcagagattcttctgcaaatagtgaaagcatgtgcccttgaccaaatgaagggtgaagatttaaggtgtttgaagggctaggattcaatattcttgtctataaaaccacactcaacaagctaagtcacttacactctctctttgctcaataatttcgaattttacttcttctctccaaacatttcaagattttactctcacttctctctataattcgcagaattgaaccataatttcttggtttctctccatacaaaccttttcaaaacctctcttaaagcctttgatcagttttaaacatcaaattctcttctaatttgacctactttgggttattttgtggtgactatctgcagtagctcaatacaagatcatggatcctaaagaatcaagaaggagagcctctgctcgagctgtggctagagggtttgctatgataaatgagaagggtccggtttggaacaaggaagctgtgagtcctggctttactcggttgacaggccgagtacagtggccgagtatgaccccggagtcttctatgggtcgttctacggctgctagagaagaaattgcaagaggcaagagggtttgggaagctgagccagttgcagaagaagaagtacctgagatagagagggaagcatctgaagaagatgtagtgttcgttgagaaggtcttaccagttcctgcaccaaggagaaggaacaacccaaggagaaagaaagagcctaccattgaagagcactaccagtacctcatggagatgagttttgaagggacaagatatccccatagacctaccatgcaagctttggggatatgtaaagatgttgaatatctcatggagatggccaagctggagacattctttacttacaagtgtgagggattcaaggaagagagctgccagttcctagccaccttgaagctccatttttatgccgatgagagagagaaggagctacataaaggagttggctatatcacattcatggtgtatggaactcattactctcttctgattaggtagttggatgctgtattcaagttccccaccaagtatgggatccgccaaaacttcagcaaggacgagctccatgatctatggttaataatagctggttcacttccctacaagtcatctagggccaaaagttcagcgataaggagtccggtacttaggtatctccacctttgcattgcgaatgccttcttcccgaagaagacaaccggccatgttaatgagggagaactgaagatgcttgatcttaccctatgtttcattttggggcacacaaggaaggggatagagatggaaggggatagggctgatacatctctttcagtggtgttgattgatcatttgataagcttcagggaatatgcaaccggcatccaccaatccggttatggaggaagcttgtgtgctggaggagtaatcacacccatactcatagctgctggagtccctcttcatactcccaatgtcacagtcaactacattgatatggagcatttgaggaagaaaggctttctggataggtcagccccagctgatcaattttagttcaagttcaagcacttcacgctaggtctctctaggctagcacatccttgcaaggagtacaccacaattagaattgggaacaacattgactttgatcctcctctatcaatcttagtcaatgtccttgcgcctttccaagaggagccgagcatggggagtgagtcacaagaagaaggagatgagctcaaccaagctgaagctgagcaggaagaccatactcggccgagtaactttcagcaggccgagtacggtcaggccgagtatgaacaagctgagttcagtcgagctgaacagtttgatgagcaagaggactcgtgtgaagctgcagcggagcagtatttctttgaagattatgctaagtccgatcaagagcgagatcccggtcaagttcacaagaagctgggaatgctcaagggtctaggcaagtttcagagaaagttgatcagtggtttgaagaagaaggtgagaaagatgaagagggcaatgaacggcatggcggttcagattcaggagctgcaaagaaggcaaagatcgccaccacctccagctgagttcaggagatgcaactcgacgagtgtggcgccgcaaaggaacgttcgtttcgacccgccaagagcctcaaattacgagctcgggaggaggtccaacttctcagatcgccgtttcaacacgctcccacccggtccagtgaaccagttggttctgaatgctgacccgagccgagagtagtattactcgggctacatgctcgacgggtcaaccgagtataaccccaacacctccacccatgatcctgagtacacacaagaccgcctggacgagtttgtccagaacctcttcgtgtaaatgttgaggtatcactccatttcactgttaataccattgcatttcttttatttttgctttgtgtggttatttctcttgaattctcctttgaatttttattacacaaggaactgtgtaatttaagtttgggggagagttcaggatgtatctaacattgtttcatgttttcttattcaaatttttgcatcatctaaggcatagaaaaccccataaaaatttgaaacattttcgaaaatgattccaaaaaaaatagagtgtcatgtagtttgcatttgcattatagggctgtttttagaatgttatcatataagttgttgtattttgcacttgcataggggttaatgatgatcatagccttctaaatttgcaatgttcactagatagtttcattgcccttgttgttagctgtctagtgcttaaccgattgaacttgaagtaaaaccgcaccatcttttgaattcatatatttgatcttccttagtcgaaactcgctgtgatttgaagctattccctatcaatttgaaccataatttgacttttaattatcatattatgcattgcttgttaaagtcatgattacccttaaaatatttggatcttcttattcatttcaccactcttgttgatccaaatagctgaccctcacatttagagcagttttcccacaccctaacctaagcttctttcaagccatatatcacttgtgagtgtttgtgaggtcttatttcgattaagctcggtagaaagtgttaggtttgtaacggcaaagatagtatctcatgtagttctagttcgcgttatccgtactagataggactaggtgggtacttattctatgggttgggaagagtttaaaagagaaaaagggttgagttcattgtttacaagaaaagggaaaagaattctaggagaagtaagctaaagaagttagaaaaagtctagtaaagagtttgagattgttaaagaaagaaattgggttattgttagctaatgaagaagggtaaaaagccctaagcttaatagagattaaaaacagaaccttagtactaaagaaagtcaaacccgctagaagtatcaaaaaaaaaaaaaaaaaagcttctcctacagtcaagataaaaagaaaagaatgggttaagaaagagttcaaaagattatgaatgcaaaagggtagagttaagttcttaattgggatgagagattggatttccattagatcttcattgattatactatgggtagatgggatcttatctttgtatgcataacttgggacttacctttagcattctcttaaagcttagtcattcttgagagatcccttgttactaaagcatattctttaagggaacatttttgtctctttagcctttacctttagccaaatgagttaaatatgcattgtgtagtatgatccatggctcttgcttaacgaacattaaagggaatatgttgatttgaatgcttgaatagactaagtgaaagattaggttgtgttgtgaagaagatggctaaagtttttaagtagagatcattcaaccaagcactctagaactagcaacacggacattgagactatttattctacatgcatattttggttatgaatccccaccttcaaacctttcctagcctagttctatttgttgcttgaggacaagcaaaaagctaagtttggggatgttgataacactagattttaacctttttaagaccttatttttcatgcatttagcttagtttcatgtctcttttcatgcattcttagtcttttttccttcctttgcatattttgcattgcattgcattgcactccatagcatacttgcatttggagtgttttacaggtgaatcaggtacttttggactcgacttggaggtttctagcacaagggatggacaaactcgagttcgtgggatcaaaggaaggacttggagtatactcggcttccttactcggctagagatcgagtggagcacacaagggagaagcaaagacgttactcggccaagacactcggcttagacccgagtgatgcacttgaggaagaagggaagcttctcgaccaagccactcggcctagacccgaatgatgtgaccaagaggaagccactcgacttttctactcggccaagacccgagtgatgcagcgccgactttcccattttgtctttttcccaattagggcatcctaggattgcctataaatagacctcttatgtttttgcccaaaatatctttgcttttgtctgttgaatattagggttcttagatttcttttgcattttctggttgttgtgttgagaatttagatttgatttcttctgtaaacttgtttaccttattgagatctatcatttgctaagtttataatgatttctgagttttatgaattttctgggttttgttctatgatgttcttcattgttcttgagtagtcttctttagagttcttgaggatgagttaggtttaggtggattcctctattctttagctagctaagtttataaatgcataattcccttatattttaggagttcttaatgctattttctttctgatcaattgaaaattgatttcagactttctccacctaacaagtgcttgataaaatgtctgaaccaactaatttcagagatttgtagattctagcccaagaccttggatgtttagactgcttattgactttaatagattggggtttaaagcctgctttgttaagtttcatcaatgaaaattgagattaggaagtgataaagttatgagagtcattgtcacgaaagtggattgatttgtttttgaatctattgtctagggatagcttgattgagtttgttacttagctaatggattgaggagtccactaagaccaattaccccattcttaagagctctgtttcgttttattgtgcaaaactcgtgtttttagtactatgttcgtctcgtgcaaaattggtgttcttaatattgtactcgacctgtttagttgtttgctcgaccgagtgcttgacttagtgcttgatttactttctgctcttgctatttgagttctttattttctgcttagtatagttctgtttctgaatttgatttgcatgttaaccgattgcttaggtttagtaaaaacacaccaaacctattcactcttggcttgacttagtattctctgatcacatcctgattgatagcaattacacccatttggattgacaccttaaatgatgcaatgacgtaagatgcatttagggaattgacacaccgaaaacccttgtatcagcgaagagtcctcctccgatgagaatatggaggatgagattgtagaagtgaatttagtggaaaatccggcagaaaatgatatggtaagtatttgaatggtgtgaaactggtagaatcggataatactatgatttctggataatactatcattactaggatataactatgtgtatgaattctcggtaacattggtagcactaagataaaactatgtgtatgaattctggttaattctatcattactaggatatataactatgtgtttctcggtaatattgtcattactatgatacaactaggtgtatgatttctaggtaatactgtcattaataggatataactatgtgtttttggataatattatcattattaggatacaactaagtgtatgatttttgggtagtcattactaaaatataactatgtgtatgattctgggtaacatttgtagtaatatgaatgaatgtctgttgcaggatatcgacgaggaaacagaagcaataccaccgctgagtatgtatttcccgcccttggaatatgcgaaaaaatcaagctatcaactcggtgctatattcacgaagtgttgactacattcgataagttggagcctctaatgagcatgtttgagagggcatgattttagaaccatccgagtttccaacacaacttctacatgccaagagacccaaaccatcgacttatggggatgtggatgcttcttctttgcatggcgcgaattgaaaggaagaaagaaatgtggttcattgtgaattgcgttccaaaccgatatgggatattggaacatgcattgatatcgggcttcaattgctagaactatgcactttggtataaaaatacgggaaatttggagttcaagacgaagcatttcaagaagattgttgtgaaacgcgaagacgtgagagagaagctcttaaaaatggtaccgtcgggtgaaagatccaaagaaaggttgaggatgatggtcctctatttcttaagcagcattattatagcgcctatcaagactggggaaaagacacctcaagttgatgaattttgcctcaaggctatgagtgatctcacgttttgtatgaattttcagtgggggaggtattcttttgattacatgttaggaaccatcccacacacgatttctcattttaatggtttagtcgtcaacaacaagaagtacatatgaccgcttccgggtttctgtgttccgatggaggttagttataacttatattaattggtgaatgttgggaatactggtaataatgtggaatactatttgttattaaaaattgttttggatctctgtagcttcttgcattcgaggcaatcccacagttgagggaaaaatttattgaggacattgtaggagcagatcagtgatgtcctaggatgtgcaaggtggagttcaagaagaaccatttgaaaggatttcctcttgataccatttatgaagaattgggtacctcaggttagttgtcctagatatactgtttttgggggatcagggatgttacagatttactattctatttagttataaagatctcatatttgtttatattcaaaggtaattgattctctcgtcacacctagaattgaagagcaagcacttatcaaagaaatcacggaagaagaggacgttgacatctttgatgtggtggtggaaagttggttgaagcgtcataaagatgaccgtctaatcagatttgaagagctctaccagcaggatattcaagcccgaagaatcaccgcatgaccagcgattaagggtgaggaggatattcccacagtatgtggacaagaactcccgagtttggttgctgtggtggagatgattgaaaacatgaataagaagatggtagaccagctgaatgaaattataacattgatttcagatttggataaaagagttgaatcgttggaagcattcaaggatgagcagaatgtatagaagagaaagttacgttttgtaatattgagtaacactgtattattattgagtaacactgtgttaactagagtataatagagtaatactgatataattttgttcaattgcagaatcaagaagagaaggaaggaccacgagaatgatcgttctcaaatattaagtcaacgatgcgtccaccacaatgacatatctccggaactccttccatcattaacacttctttctccattatcctcttaacgttcttcatctcatcataccacaggtccctctcacacaatcgatccataactgattggagagagagagagagagagagagagagagagagagagagagagagagagagagagagagagagagaggtgtgaaaggagagagagtttgagaaatcgaaaagtttcaaaaattgaagagaaaaatgttgaaacttggaatatctagagaaatatccgtttgggagagatgggtcgggtgtggatcgaatagaaattagatttcggttggggtatacaagtaaaatacatagttttcgaattaaaattaaatcaaaattcacttctgttttgttaggagagatatgggattactgtttggcagaacgggacgcccgagacattttttcaatactcatatgcaaaagagagtggtaatggcttcaatgggactacaaaattttataaggatttcaaaattttagatgatgattttactcgttttgaatatccctttgtcatcactttagcatattatcaccactgctttatatcatttctcatcatttctcatcactttgcatgtttaggatagttttgcatgcatattgcatagttgtgttgttttcaggtgatttggagctgctgatgagctgattggaagaagtgtacctgatcaaatcaccatactcgaccacgagctcgagtaccgtcatcctagccttcttgaagtactcggtcacgacctccgcagctagtccctcgaccgcaacactctggttcactactcgaccccctggtcgagtagaaagcatcatcgctttagagtcttctcgattccgcactcaaccagacactcgagcatgaggaagagaagaagactccgacttgtcactcgacccactactcgaccacctgggtcgagtaccgttcttaatccgtcccagtacgatgtcgttttgagtattagggtttcggaatatttcgctataagtagcatgtactttacatttccgagaacaagtttttattccgcagacagtttaagttcttgacattttggaatccggatttctcttaatctattgagtatttgcttttcattgcgtttactaagttgtgatcatcctgttatcatcttgcaattactttgttgctatcatgttttcattattgtcatcgtttatgttttctgcaatgatgtttgagtagtgactaggtttatgaggatgggttagagtagtttagaatcctcaatatactagatggttgagttggatttatagatcccttctagattagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagtgagagttttgtttggttttggggtggggggaaattgaattttggggaaagttaatttttgggggaaaaagtgatttccatgtgtgcgtagtaattttgacatatgcgccatttattaaacgttgttttactctagtttttggttctacaaaatgtgtacatagttttacttttggtgttttcgagtttaatcagtattacatatatttcaaaatgatttatctacttgttcacttgaaggaactctatcactattgaattttaaaagtttaatgtaatcacatattaacaatatataaaattgttaaatttcaatcctaattggagtttatatcaaaaatgagtttaaaagtataaggaatatgtaggatagagtctattaacatttatttttaccaaatattttttttccctaatttaatttgttttaaatcatttgtaagagttcattatctcttgatagtctatgtaatatatggtgttggaaaaaaacataaattcgaatttcaatatcatcaatagttatacttgttgtaccagtattgcattatttcttcaattgttatactagtattaccattattgcataatttcttaattagttatactagtatgacccttatgccaatgaatcaaatactacgagtgccaaataacaaccattgcagcgactgcctcggcctccttttgttctgagtcttttgaagttttggacgtctttttctagtggatgaaaacctaagaacctttgttctacccttcttctttttccgaggtagaggtaatactttcaacgctttgatgtcttccgggatatcctactgtgatctatccgggactaaataaatagtcttataatacgccaatgactaccactccgcccaataatactttaaaaccaattaatgtaattcaatacttcgagttcttgttgtatatctctcgaaggcaatgaaagcggctaatgcttgaacacaaggatacttttggatatcgaacaccttgcaactgcaagttgatcaaatatttgttttcttcatctcttcggacattgtattccagcggaatgtgtttagctctatgacttttagtttctcagcatcaacccagaaatcaactacttgattgatgttcagatgatgatgttattgtaggtgaaggagaattctgctctgctgaacaaatgtaatccctttattccagcaaatttaatgttttagttattttctttgttccaaaaagtttgattttctactgtttatttagtatatctgtttaattaataattaaaataaaataaaaaatggagtgtcattttggttaagaagcttaaacgtccaaaaggttcactcttttatttacactcattaaatatcagtattaattgtttgtcatttactctcattgccttctacaaaccagttgtcatttactctcgttgctttttacgaaccagtgaagaagctatttcattatttcctttttttgcttcttcttatgaattttttttctctttttcaatgaaagaagaagaaactaaaaacgaaatgaagaaagaagaaggagatttgattgatgttcaacatactcaaaacaaatctaacaccatggagagataacccgaagaagaagacgacgaactggttcaaccgattccaagcataacgaatattgttccgaaatttgatttgaacaagccatatgacgatgaagaagaccaatcaagagatgtttatcagatttatgacatcaactctacattcacccgagaatttgatttgaacaaaagattttataaagaagtaggggagctacatcctcacaagaaaactgaagatactatattgacaatgttaaggatatattttcctaatttttattattttggtagtttctaaaatttttacttttgtttcctattttctaggctttgtttagattatctttattttttgtttcctaatttctttcatttttgttatgaacttgaaaggaaaaaaatgtaattcgtagtttctaaatttgtctcttctttttcctattttctaggctttgtttcctaatttctttatttttgttataaatttgaaaggaaaaacaaaatataattcgacaaatacaaaatatataaaaaaatttaagctataaaaattctttttgtttcttaatttactttttcctttttatgtttcctagttttattcattttgttatgaatgtgtgaaatctttttaaactgtgttaatgtgtgaacgtgagaaaaccaaacttttataaatttattttgttagtaagaaagtcaccaagtttgttcttttaaatttggaattttgtattttgcaaatataaaccatcgaatataaatttaaaaagtttttcaaaaattaaaaaatcttacaaaatgttgattatcaaaataaaaaacaaacatacagtgataataataaaaacttagatagttaagtaatttactacatcttgtactaaaataggatcacaagccatttgtgaaggtagattaccttctttcttcaaaatagatttcttcaaatgtgggattttatacttgttagagcctcgaactttcagattttcttgcatgcatgattgcaaagtaaaaaaatccggttcacttgttttgtgggatattcatcacatgaattttctaccgcggaaacaagttcttctatcgtctttggacacaccttgtgttgtagtgtttgaatggcactaaaaaatccaagatctaaaatattcaaatcgggcaaattcggtggttgacacatcaaatgaatgtcaaagccatgatgagaagcaactactcgaaattcctcatctctcaagtcaacgtgagttcttacattatcttgttgaataaatattggttttccaatatcctcttgtggccatatttcacgaattctcggtataagttttccaattaaaacctcttttatattttctctctatgtcatcggctttaactccaaagtacccgcctcaagatttccacttcttctttgagccggttgcatagtaacaaatgggaacactcctatttttccagaaaatatttcatttccttctccatcaaatcttggacgagtcatggccgctaaaaacattcccttcccaatgtaatttttaccttgacatgtacgatacggctcttcttcaatcggaagcaaataatatttttctttttttcttgtcatataaaaccatttttcatcgatatgcacaacattgtacatatcaacaaattttgggttattgggcaaagaactattatcaagtatagagagacaaaattcaagtcgagctctcatattaccttctctcaaacatggcttgatggcatttggatgtcatctaatgagctcattttttagacatcgaaacaatgtagtacagctcatgtccaaagaagccgtcaatgaccgtaacgtcttacgacgatggagtggaatatcaacaatccgaccaagatcaatttcaatatttttcccaccacatctaccttttctctgatgtgatacatcaataacttcattactaggagtatttttagcccgcctccaaaattttgtaccgtttgtaaaagcaaggaaaataaattagcaacttccgtcgtatgaattttcttcaatttgccgttgttgcttctttccaaaagagcaagataaacctcttgtctttctctatctgtcattcttttattacgaccatgaagactttgtgatatctcaacacttcctcctacaaatattttgaaaacaataaaatattaaagcaaacttaactaagaacaagctaaataacatgattcatttttaattctttataaatttataacctcatgataaataaataagtcattaagtacaaattaaatttataaactcatgataaataaataagtcattacatgattttatttttaaaaaaattagatatatatgcagttcttttaacaaataatctgaaagtttcactagtgaatcactatgataaaagacagtataataaactataaatttataaataaaaatacctgaatttatgaaagaaaaatcttcttatttttggttgagtggaacacccaaaccttcttgttattggttgagtgaaacacccaaacaattctctagagaagtctctcttgttggacttttgttcaaatcaaacaaaaactcttgttcattattttgaagtggtatatttagattaaagccatgaaaagccattgttgaatttgactccatagtataaattcacgttgatttatatagaagattagttgaatgtagttaaggttataggctccaatctatttttttttgtatttgacttaacataattgtggctccaaattaaaattttcaattattttgagtaaacaagttttatttggaaagtgaaaaaatgaaacggaagaagaaagtgaaggaggaatatgaaagggttacgattttcagagagagagagaacttgctgcatgcatgtgtaattctcattttcgttgcatgtgcaagtaaaacacgttatccgtaattctcattttcgttgcatgtctaaggaaaacatgttaccttgaattgggtttttaattaaataatgagaaaagttttgtgtcttaatttgtgtgcaaaagttaaacatcaattttgctggaacggagggagtacaagattggtcgtattccacttggacgtaatgatgccgctgttattgttaagtcagtgtcagacgccacaacttctttgtcgaggcctacaccatcagttttcacacttggtgaagctttagggaacaagattgtctggcattctagacagtgatgatgtatcttctttttttgagaatcagactccaggatcttcggtaatgtctttttcccatcacttgtcaattatctagctgaacctaaacactatacctactcacttaatatttatgcatcatgccttaggctaaagattcataaaccgttaaaatcatcataattgattggaatatggttgattctgttgtttgtgagggtcaattgagttcaacataccgacaagaacttgtgaacaatatgcctcttggtctttctgctgcaattgttaaggttgagaagatgtttaacaaagccgcgtatttatggagaccaagtccaagaatgtttgtaatgggagatgtactaaatgagaacattgcatggccacttcatagtatacaatatgtgaatttatctcctccactgtatgaaacagcatcagcagataaaaaaccatcacctccactggtaaatttctccactttaacttacagcctataaaagacaatcgcctgaatgcttggtattatttttgattcttgtacagcttaagtaacagtactgctagcaccagcaaatctgccaagaagaaatgcatcttgttagattacaagaacgggagagaaagagtagcacaaggaagagtatgttcctctaatccttcagacacagtccatcatatacccctaggtccaaatgcgagcaagatatgggtagatgtttcaaagattggagatgttgctgggtggagaccaaacctgaaattcaaaccatagctgatacagtaggtagcattgtggcttgacctactgataaagtcatgttcgtgtaaatattatgtgtttttttttgttaagtactgataaaatcatgtttgactttgacatttaaatgtaatttcggatctttgattttatctaatataaatttccttttgaattttaaatttatgatataatatttgaataaatatttatttgattaaaaataatttatgaactggaattaaatagagaaatattgcataattaaaaatgctttaatttattaatattgcaattaactaaatactattgtttaattatatgtaacaaactaaatatgctatatataatagttatttataacaaaaactagtcactattaaataattaaatattgtaacagttaaaagcgatgtaataaatgaaataatgatagcacaaaaaaaagcgcaaataataagaaagaggaagatagggtaaaatcgtcaacacacatatcacttattcagtaggggatatggagattaaaacaggatataagaggtttactgttgacaaaaaggcagttatgagatcatttctccatgagtattatatcctgaaaattcacaaagaatcctccattttttcttccaaattccaaatgttctctcaatcacagaacgtaaagatgcatgaaatcgattaaacaattcatgcctatttctaggaggaggaccattttcaaattgtgacgtatgatactgaatattcctatttcgtgaaaatttatacggagcaggaaaattttgttttgtggatagccggaatcaactacataatagttgtctgttggaggcaaagaaaattcagaatcattgtcttgctccattgtgaatcaactacataatagttgtctgttgtatcgtgacaaaatcttggtgctccaatccatacatgttcaaaccacatattgccataacattgaataatgttctcccatgtcgatcccaatacattctttgtaattcacgtttcaccttaacacaaacatgaactccatccattgctccaacaaatccactaaaatatgaccaatatctttggtctagttacaatcgttcaggaattcggcgtagttcttgccttcttggagtctttatataattacaagcaagtaactatgtagctgttaggacctcaaaaaatttcctttttactgtctattgattttgtccaaatcgcaatctaatatctctttaaacttcattgtgaccacaaatccatagaaacattgtcaccctctcttcgatgttggttgtgaaccataattcagttgtaatgtttcacttaatgttctaaaacaactaagagacattcgtaataactatagacaagcagcatcatcttcttgtagacgacgccaaatgttttgccatcccaaaccgccacctgttggaaatggtcctcgttgaaaatactgattgtagtaactcaatgctagctaaattatcaaatcttcaaattgctcgttttccaaattccacaactcaattctatcctcgtaacttagaaattggattcctcgtgatctcagctagcatatacgaaaaacctaagattttgtaaacataagataaaaattttttagatcagtataaaagtttaaaaccattaatcattaatacaatacgtaaaaatcatcataaaacataaaacaaaacatgacatcctgactaataacaaaacacatgcctattaaattaatcttcttctcctgaatcatttggatgagtttcatttaaattaccctgtttgtttcatcatttatcatttccattcggatgatccacttacatgattcatttgaatgatacatttgaatgatgtttgttttattatttgtaatttaatttaaatgatgcatttaaatagatatttatttgtttgataattttgtaattcatccacattcttatttagataaaaatgaccaaaatcttcatgctttcattttgacaaatgacaaatattcaacatcattacacattatcaataccaaacatattggcgggaaaatacagttttacggttttagcgggaaaatatgattttgtggtttcgcaaagaatacacgattttacgggtttggcggtaaattaagattttgcggttttggcgggaaaacatgagttttcggttttggcgggaaaacatgattttacggatttgcgaaaacatgatgttatggttttggcgggaaaatatgattttgcggttttagcgggaaaaacataattttgcgattttggcaggaaacatgattttccggtttcgccgagaatacacgattttacggtttctgcggtaaaataagattttgcgattttggcgggaaaacatgattttgcggttttggcgggaaaacatgattttacggttttggcaggaaacatgatcttgcggtttcgccgagaatacacgattttacggttttgacggtgaaataagattttgcgattttggcgggaaaacatgagtttgcggttttggcgggaaaacataattttacggatttgtgaaaacatgatgttatggttttggcggggaaacatgatcttacagttttggcggggaaaacataattttgcggttgggtgggaaaacatgattttgcggttttggcgggaaaacatgattttttgtttttgcgggaaaacatgattttgcgattttggcgggaaaacatgattttacgttttggcggaaaacatgattttgcggttttggcggaaaaacatgattttgcggttttggcgaaaaacatgatgttatgattttgcggtttttgccaaaaaaactcaattccacgattttacgatttttacataaaataataatccgtgatttcatgatttttagagtttttttgtttcaatatgtaattttaaaaatattaaataagaaatttatagaaaataacattatctaaattatgattagaaatgagggtaaatctatcttttgttattttgaatgaaccatctccatccaaatggttcaatcaaattcatccaaatgagtttcataaatttgcctaaatttataaactcattcaaatgtatcatccagatgatccatccaaatgtttgttaaattgtcaaaaacaaacatcatttttcatcttcatttggatggatcatttggatggagaaacaaacagggactatgtcctcgttttcttccccaaatattgaataatctccatgctctacgtgttcgtggtatttgctctgctgaagaagtatgagctggtattctttcacaatctatgtgttgaatatttggtgtgatttcatcttcaaatccaattgaaaatccacattgaacatttgctggagaagcccatttgtgaagaattcggtgaagaggcccaatttgaaacatttgaggatgaaccccattgttgataagtactccaatttggactatttgacgaagaaccccattgtggcctatttgaaaggtgtaccccaatttggcgtaggttgttgtgttctctattctgaagcatttggtgaattacactactgtcgatcatttggtgatgaaccccatttatgagcatttggtggtgtaccccattgttgaacacttgttgatgaactctattgaggagcatttggtggtgtactacattgtggagcatttgtgggctatccccattgtggagcatttggtggtgtaccctagtggccacctgaagtttgaccccatgaattaccactaaagtatggactgttgtaaggaaaattaccagacattggactgccataaaaaggattgagaagctccccgatccaggtagcttcgttcttgattgcttaatacctactagcagatttagtcactccatgtgtgatttaggatcaagcatcaacctcatgttcaagtcttttgctgagagactatacatgactagctatagactgacatggatcactctcctcttcgcggatcgttccaaacgagtccttgaaggtatccttcaagatgttcatgtgagagttggtaattgcctcttttcttctgatttcgtggttctggcatatgataaagaactcaaggatcctcttatccttggtagagctttcgtagctacagctggtgctaagattgatgtgaagaatggaaggatatctctcaacatatgttatgtggagatggagttttgcgtggatggttcggaatctacattgcctatcagtagcattgcaacaaacaaggacaaacctcctaaggctgctctgatttcaactccaaagccgactaaagaggctgttacagctcagctcacaaatgagagatgcaaagaagcagtgtcgatcgacaccacacttcttgtcgattgacaccatcgcctttcacattcagatgttttggcacctcatccacagtccacaactgcttcaattcccagtgataggtactcctctatctcttctcttactattccttcgattatttctttagaatctttgaagtgtgcttcaacggtaaacaagcatcgagattctcgagagattgttgtctctacttatcttgcaggagtgactatcgatcgacacccacactagtgtcgatcgacacctgatacttcatagagcccatttgtttacacattactttcgaaggcgagattgcaatctgctaagcagcacaagtcccttgtcactccatccaagtcctgaactccgccaagtcaatctattgactctaaagaagcgcgtagtgggcggcaatcacccactggtaggattgttcttttctttttcttttatttttgaatttttgatttttttccagttctttgcgaatttgaatgccaccgaggaaagtaacgtttaagtctagggagacgtttattaactatgcttttatttttttttcttattatttttttgtttttatgttattgagtcattttcttttgggtgagttagctcaataaccaaattttgtaatgttattaaataagtaacactataatcggcaaaatgtagtgagtaacgcaactggagtttgtatttacaacccaattcttaacacaactatttgcagtttcttggacgtgcatgaggcagagagaattaggactgatttatgctgacgttgttgaagctagaaaaaattttccatagcaacgcttcagaattgtcccatcaataacatagcctgcactaagtttaatttgaataaaatactctccccaaaaatatcagaaaaaaatatgctctaattattgacagtaaatgctatactttttacgcacagatctcaacctgtaaacagaacagtattgatggtggtgaaaatagttcggcagttaatatgagaatcaaactggaaatgtacaaaaccatcggtttccagtttttgtttttactttctgccgatttaattttatattcaacactttccatgtcaaagtacttactttccctttcaaataaactacttaccatgattgtagatctgataaacaagttgttaggattttttacaattcgaccttgatacgtgctttcggttttactgataaattaatgaccacgcttagttaaatgggaaaattgtgcatacttgttgagatttatatttacttgttttttctctctttctaaatcctaatgacctctttacatacgccatgtagacggcaacacaagatgaagtcttgtttgttattggcgagtcggtgagggttgataatttggcctggcagtttgaacctaagactgtggaaggatcgtcgtacatccgcctccggaccaacatgacgtacaaagagctagctcagaaggtgaaagagaaattttcttttcgtgcaagagacatcacaatcaaaattgcttaccaatatccagagtggatggctatagatgaaggaaacgggtcgcctcttcaatacatcagtgaagatagtgattttacaatgttcactcaaatgagacgtcacatagaagaggtcaatctctgtgttactatagtccaacatactattccaatttctcctgttgatgtagcatgcaaggacttcaattgagaggacagtgaggaaacatattatgactctgaggaagaactgcaccaattttcctttgatagtgccttggtgggtgcaacgcaagacccaacgcctcctgagacaaagcaagagtcaagaagtattaccaggcgggaagtttttcccgcaagaggcatcagtattagagagcctgaagactgcatccggcttaaaagccctgaatgtggacctactaacaaagggaaaggaatcatggacaaaagtgctaagtcaacgaaggctggtcctagtagagcaagtgggacataagacaacgagaatgaagaggattttctcatcgttccattcaccatgcaacctaatctgaccacattccagaaaatgatgatttagaaggcgttgattcatatagggctgatgttggcaggcctcctggcaatcatgtttctcctattacaaatgatgtggaagaaactgaaattcaaaggcagatcattatgttttgggggcgggcaaaagacgctttaaacacaatcctctccgatttcagtgatgagcctatcctattcggtcgagacgccccactagtctttaatgatggaaaaggtgaaggtataacttgtaatctggctatacatatataattgttttgttgatttgttttaagaacttgaatttgctagttcgttaaaatagtttatgtcttgtataccattttatttagacatactggttctatttaagtagcataatacatacatttgctgaaagatgttcattttgtttcaggtgtgggctctgctttctttgatgtaaaatacgaaagagagaagctgtttgttggcatagtatttaagtccaagtctgattgcaagattaagattgttatacacgccatcaaccgcaagtttcactttcgaagtgcgcgttctactccaaagtttatggtgttgaaatgcatctcgaggacttgtccatggcgggtgtatgcttctaaggttgattcttcagacagctttcaagtgcgacaggcaaatcagaaacacacatgcactattgatcaaaggtgtagagaccaccaccaccatttagcaacaactcaagtaataagggaaattatgcaatctcgctttcttggtattaaacgcgggccaaatgctgcagtgataaagaagttctttcttgacgactatcatgttaatatatcttactggaaagcttggcgtgctagagaggtggcaatggagaagtcattaggatttatggtcggcagctacgtactaatccccgcttacgctaggctacttcagcaagcaaacctagggagtctgtgctttacagaatctgatgatgagccaaatggtccacgccgtttcaaataccaattcatcgccttcgctgcttctattaaaggctatgcatacatgcggaaggtcattgtagttgatggaacatctatgaacggtagagacggtggttgttttatatcagcatgttgccaagatgggaattttcagatcttcccaattgcttttggtatcgttaacagtgagaatgttagcgcttttgaatggtttgttcagcggctcagcattatagctcctgacaatcctgatttattttttatatctgacagacatggtagcatatacacggggttgagtaaggtgagaaacaacattgctttgaagcattggggcaaatagtataccgatagagatgtacttattttacatatagaatctggttcacaattgacaagtacagtttggcatcaggtctatacgcaagccaaccacgctgcttgtacggttcacctttggtggaatgtcaaaaatctctacaagccaaaaagcctctgccgactaatgtttgaagcagcacaagcgtttcatgtcactgatttcaatcggatttttctgaagatacaaaaattaaacccaggatgtgctgcatatttagttgatttgggtacgtttgtttgactctctgttattatattggtcagcttccatatagttatagtaaattggttgacaggattgtagcttacataaccatgtatattataatgtgtatagggtttacagaatggaccagagtgcattcaaaaggctagcgtttcaatattatgaatagtaacacatgtgagtcatggaacaacgttattaaagaggcacgcgagtacccacttatttacatcctggagtacataataacaactttgatggattggtttgctactagaagggctgaagctgaagactaccactttagctccgagagtgcaggaaagagttaaggaaaactatcaagacgccatgtcaatgtctattaagccaatttgcaacttcgagtttcaggtccaagttcggactggtgaatgttttattgtcaaattggacgagtctacttgttcttgcttggaatttcagggtttaaggatacattgtgctcacgcaatagaagttgctgctcggcttggagttcctacagattttttggcagcaaacgaatattttaatgagttagtgaagctaagttacgaggagaaaagctatccaatttagtctgttggtggggaggtcgcacccggaatagcttcaggaacgataggggaggtgcatccaccatttgtttggcggccacctgggagaccaaggaagataagaatattgtctcgtggtgaattcaaggcaagttcagaatattaaaacagtacatagtccattctattttttaaaagctaacagcttctatacttctaatttgcagtgcaacaaatccagttcccagaggaggtgttcacgttgttgtggtgttggccacaacaaagcctcctgccgtaatgctatgtaagtcgccaactactgctatggggtgctataaggtgttatgaagtaactttctggttttggcaaaataatggttgttctcgcctactctgcggaagcgagagtgtttacttctactaatggaggctacaatacaagatagaacgtcgtcgttttaatgtgggggtaatctgtatttagggtttatctcttcaattatcgataacaaaacagaggttttgcgagagagaaattgagacgagagagtgaaacaaaaatgggtgatagagggagagggattccaagtcgatgtagatgtggagaggatgtggttttgaggacatcaaaaactgtgaaaaatccaaggagactcttttatgcttgtcgatgtggagaggaggtaatgatattgtagtgtaagtactgttaaattatggaacatgtctgaattgtgtttttggtatgtatcagaatggtagtggtcacttgtttaggttgacagatgaagtaatggtggaagagatggaagacatacttccaaagattgatgaacttgaaggggcttcattgaccttacaaaaagggttacaagctttagaatttgagatggaaactctggcaatggagactcgtacatgtgaagctgtggtttgcggctatgagaaggagctgctaggtttagagaaggagattcaaggttgcaagattgaattgcgtgggttgaagaagattcttgtgtgtaaagtgttgatgactcttgtctatgtgtttgtgttgtagtaattgtagttgtgtttgttttgtattgatacgcatgttgtagtgatttggttcccttttgtgttatgtattattcagataatgcacttaccaaagatttaaagaagttgagtaaccataatgtggggaaaataagtatcattttggttacaaaatccttaatctagaattcacataacatgaaaatattatctcatgtatcttataatacaaactttctgcaatcttcttaagaacatggctaaatagcaaacatcgctattaattggtgaatttaaaaaacaaagagtcactgattacataagaacattcggggttggatggcagctttcgcacttgtaagactcaagtagtacgttcttctggagaaaaggcattgaacgtttcgatagcgtactctttagctgcccctcgcatcctctcttcgtctagtttagcacaatagtccatagcgttaactgaatgtagctcaagtaagatcacacaagcaattccaacaaggcttgaaaatcacacgtgaaatatatatgtcacacagtcaaatatgaaatacttatcgaaacaagataatgaaagacaaccatacctaacgacgaacaattaaactgtaagttgggtctactcattgtcataagatcgagcctctatgttagcattcttccgtttacaccatgcttttgaataaggtacaagagcatgattttatgtgttctatgtacttcgccaactgctcgtctttcaacacttcactcttgcagtctaatacaatgattttctatttcatcaaatcgatgacaagcccaacccaatgctgcctctcaacctgcattgggcagtagatgacatcaacctcatcaaaccattttggtcgcaccatggatgggactcttgtaagcgtggtgaagtaaaaaactctcttacctgaagctgcacaaaatttgttgtattggcgtcgtagctctgacaagaaacttgatggtagaaaatcaaaatgcagcggcttctttttatcccgccgcatctgaatgaacctcactaaaagatctggtccttgtggaagtcactttttttattagcacacacctttaatacttagttttctactaaaaaagcagtgagcacacagttttatttgaaacaacacagattgcatgtataacttactacttcatctagaagtgtttgcgcctcgtaaatagttagaaattcagtattctccattacaacgccatcagcctgaaaataagatctacatggtaccatataccagcaagttagttgcgaaagcaaataagttcttctgaaaatataggggctataaatacttacactctccgttctatttgtttaagaaaacatttcactctctctgcacttggaacagcgaatcggtcatatggaccaatggtggtggatttggaggtatcttctccccttttcctggcctaacaacatgaactttagtcgaccctctaacaggtgtttgtcgctgctgtaccggaatggtaggccgactctctcttctgttgtacatgacaggactgtccctaatccggtcgctcgaccgcaacactatgacttttgtggggaatgtcttcttcttaccttttggaggtaacctgctgatgtcagcaacaatttcttgcgttaggccaacaaaacgtttggggcaataacatcacaatcatcttccaagttcttttctgcatcaatatcctgcatacatatacccatgtacatagtttagcatatatacatcatttacctatagtttaacatctttgtcatggcttaccgggttggttgcatgcaattcttctttgtttctaatctgtaatattcaattagagaaagtaagtgggtttcattcaaaaaatataagtgctagtggattaaatatacagacggatatagtaataccttactgcttgacacctgctccttctctttagctcttttaggtggccgggtagattgggcgtccatatcagaaatggatttttttctccgtcctttttgagaagcagcgtcacctcagacctagtagtacatcacatttctatgtcatatttactcattaaaacaaatgagtaacagtctttaccgtatgctaacctccttaagagatactcttgctgccatctgacacacttaatccatcagttatgccacaaacacccgctacactgtcacttcctccaggtagccaaatatcaagttcatccggctgggaaccaacatgcgtatgccttggctggtcagagcttctatgttcctatttcatgaattgcaattgtaacataagtatattatgtcacttaaaatggaatggaacataaatgttcagttttctaagacatatacaacaaatcaaggtaacttaacctttgtagagcatgactctgctacacatttgttgcattcccctttttgagcatgttgtatattttgcccacttaccagttccctaacagattcagcaatcattgccaccaattctttcttatgcttatctagttgagcatcaaagtatgccttcaagtcaactgtgttcgcctgttgaatcttgagaaaacgtttttcaaattcatcagctgcctctttgatcaatgcactactactatgttgcctttccccagcaatcgggacatcatgctgcaaatcttctctagcctaaaaactgtcatcatttttttgtggttgtccatcatcaacaggaacatcaacacccatgccgtcttcacatacaccggttgcaccctcttgtctctcttctgcagcaccaccatggacatcagcctccatctcatcttcaccatcaatcttagacgaattcacaccatcatctgcaagaactcatcatcagatggttgtacaatatcacaagcgtccatgccaccactccaactgttatgctcgtatgggtgctcctctattattaaagatagcaggtgtgatacttcttcatcctcctcctcatcagataaagataagtcgatatcttttgcaagtagtttttcattcagcagtgatgtgacccagtcctacaatataaagttgaattggatagttaaggcatgcacatacaattttaataccaaaatcaagtagctgacatacaatataaagttgaaattggatagttaaggcatgaacatacaattttaataccaaaatcaagtagcagtctacataattaagaacttaccatgccatttttggtctatagtgcaaacgtcatgcacattgatattcaagctccttcccagaacagactgaaccagcttctcaactgaaattgttgggtctagtatgttaataaccgagtccaacgtgtatatgatagctggacatgcggtaacagtcacaagaactaacgcatgcgggaacccttgtatggctcttgtatcttggggaagttccttggttgttctttgttttgcgcttctaattgtagaaagaaacgaggttctgcccatggatatttaagaaatgcaacaacatctttaaccatctctacatgttcaggattaagattgttcccgcacatgtcaggcaaagaattccatcaactattagaagcaaggctaggcgaaaccgggttagcgggtctttgtatttcttccccatagaaagctttcctacaatccattttgaagttgactttctctctttaccaaatagtgacttgtagaagcttgtaggattctgaaccgctttcacattccctctagttcttgcatccttcttgttgaagtcagctttgctgaagttaagaccagttaccagctcaaaatcatcaatgcaaaagtgaattggtgtcccaacaaacaaccaccgcatctcatacttcttatttgtcaccaactgtctagatagaatgtaatgcaagaacattacagaaaatcgatgggttcccatttgcaagatacttcgaaatttggaaccatccaaattctgcaaaatgctcttcatctagtgcagcctttataatctcaatccacctaagtgtaaagtaattgtttatcctctttcgaccttcgggttcagaacaaagccgaaagaaacgctttgtcaactcatcatcccccatttaacagataccctgaaattcaaaggtaccattatcacttcttttcgcttacgagatacccaaaacagatgtatacaaatcatgtaatctaaactggcactaaatgttcaataactcaccatataggtggttaaaccacacatgcaatatgtagccatctttccattagtttcaggattacatacacgcttaacttaacactacaatccgaccttaacaacaaatgacagcaaatgctaaagcgaaaaaaccacataattaaacacacaaatcaattaggaaattattgaatacagttcatcaatgatttgtgacaaagactaaatatttcaactcatacctccgactttctaaactttgataagacaatcacgtttgtcgatggagcacttcgaatccaccaatgtttcctgaaattcgatgttcgtataggtgccgtcacaaatagaaccaactgttctcacttctatcaacccaaacagagttaatctctaactaattagaaacccccaaatgcaaaatgcacaaaccctagtcgcaactcaaattcgacgattatatagtccccgccacaaattgcacacccggaagttgcttactcgacttcaccgtcaccagccctgtcgccgttatgcgaaacccccaaatcgaaaaaccggatacccttgcatcgccactctaacggtgtcgatctatatcactcttcgaaactttcccaagttgctcgttttatgtatccacgctttattttgggtattgtaaattctctgcaattcaccctcaatttgaattttcacagcggcaacaatataagttcgagatgaaagaagcagaatgaagaagaaagagagcgtgtaaaccacgcacatgttatgtttggaattattatataaattacatcacatatagtttgaggtgttagtttttcaaatataaagtttttgttggttagttttgctaatttcccttttctttttttctaacaaaaaggtaagaaaacaaaaagaaaaaaaaaacgtttttgtatagtctagttaggaattatgatatgtatttctttagattattgcctggttgattattgctgaaagttcgactcaatccaactattggataatccatatggcaaaccgagagacttgaggatatcttggtttccaacacaatccattaaggttggagctaatctcattcctcttccttttacctcatcaaaacggttagtattcatagaactttactccttctttatacctggtaatatatgagatgatatagaataagttatcttcccctatgtaatataaaaaaaaagtgtgattgagatgatttcttgtagtgtaaagggttaggaatttttcctttgatccttttatcttacattctaaggaatgatcaattgcaaatgttgaaaaatatacggaggatatctatccgatgaagcgagtactcctttatcctatctctgaaaagaacaagtttggaggataaaaataattaaaaaaagaaagaaagagaatagtcgagttatcatggtatagtacaagaatgagtctagaaagttcttgaatattagattgcttgatgagacccaagaatgaaagcctggtggatatagttgtggaacttaggtgtggaatctagaatgttgtgtaagcttacgaagaattacatgttggttaggatttgattagacttgctaggcaaatggatttagttagaatgatcatggcaatagactagagaatgttgggagttcctttgttcttcttccacgagttcggcttttgtgttttgcttgaaggcaaagaataaactaagtttaggggagttgatataaccctattttcactgtttttagctatgttttaggtatatgtttttgagtcttttcaggtatgctatggattgggacaagaatggatataaggaggcattttggagtaaaagcagaagaaaataggccaaaggacgaattcactttcagatcaagacggaatcaagggacctttctctctctaaaggaattcaatcggaatcaaggggtggttctctctctaaagaattcgagagaaataagagagagacataatctttatagttaattatagtattttcgaagtacatttgtcattggatgggttaaattgtgatacaacaaatttggtacccgacttaatatcgaatgtacttcaaaatctcacatcggatatccatatttttctttggatcgggtaagatatatacaaaattataaattgtgaagcggttataccatatataaaaatataaatatttagaagatttgcttaagatttaaaattacaattctcctattattaaacattttttaaatgttttgaaacatcacataatatctcaaattaaaaaaataatcataattttttttgttttgcatatattgtgatttaaaattttgaaaagggatatatatattacccaattgatgaaaatatgtgtgttcaacttcccaataggccaaaatgaatccaaagccaaatgaataagaaatttaacttagcaagcatccaaatttagctttaacaaaacactaaattcttttaaacctctctacatgcattaccatattttcgaaaccgaggcgctacaatttagaaagaactgtccacgaggcaacgttacctctctgcttcagaaacggatcaacttggtcacgacatctcgttattggagctctgattgatctccaagcgtctcatttgttctaatcgttacgatctcgctctagaggtttggaaattctcgcttaattaaactgagagtttaacctttttatggaagtttcagattttggttttgccaatattgtgtatatacagatgttgaagtggatggagaatcaaaaagatattcaatttcgtgtttatgacattgctcttagattggatttgatcatcaaaactcatggcttgaaacaagcagaggagtattttgagtagctagtacatagttctgcctcgtcgagagtagcaaaatctgcttatcttccgcttcttcgtgctaatgtgaagaagaaaatggttaaagaagcagaagctctaaataagaagttgaattgattgggggtttcttgtgactccacacccatttaacgaaatgatgaagctttatgaagctacttactagtatgagaaagtagttatggttgtttcgatgatgaaagtgaataagatatcgagaaatgttctttcgcactataagaaaacaagcagtttgtgattctggaaaacatcctgaatcagtcccaaaacaataatttgcgactacattaagactaaaaatatggtcgcttttttggttgcaaaataaagtactcacaaaattgtctcaaatttgtgacactttttgacaactatttgtggtcggatatgaagcaattcgtacaagtttataatgatttataaatactaatagcgaattcaattgccagaaaccgtgtaaagatgaaccatattttatcaaggatattctgtagcggaaataaacaaagaattaaatctagatcttagggtttgattatacctggatattttgcagcggaaagataaaccatattatatcaaggttgttttagcaccccaaatgttgtgcctctaccgatatctacacgcacacaaactggatcagatctagaatgttagttcctttaagatctaatctcaaaacttagataaactatttgtctttttctttttagggttttaggttttgttggttttctctagagaaaaactttctctaaaatctatctctatatatgtatcacgttgcctttatatgagatcatattaacataatcgaattaggaaggcatatgggcttttgacaactactccaaatctaatttggattacacatctatgacatatcaatatatgaatgtatgtgtatttaaaatacatattatttaatttatctaataaataaataaaaccttaaaactccaatattagtttaatccaaattaaacctatatatagtttgatccaatttgcttaggtgtgtgaccctgtaggttcgtataatattaacaatgagtttctgactcataaattataagtggtctctaccaaaacattataaccacctaatattatacgaatgtaaaaccttgacattacaaatttaattagagtaaactgatttcaggacatttctaacaggatattagcgacttaaatgagacattatttggtagtcgtatattagactgtttacaatgagcctgtttcaaaaaaaatcaactgcttaatgaatgcagtgaaggtgttgaataatatgaaaagtatatgtggattaaattgtgttgaatgaattcaacatgtttaagaaaaaaaatgggacctatgttgctacatggtgaaccgtaattggagaaattgatgagcgaagatgtctgttttttggtagtgatataagtattattttcttattggttactcagattttcgtattttttatatcccaattatttacactcaattattttattataatataaattttgttacttcaaaatttttatacaaaaattcatcatttttaagatttataaataattacttgtttcatatgatttggacacataaaaaaaaatcctcttattataaaacggattctaacaataaccctttaaacacccaaaattcttctaataacccttttaactacccaaatcccaacaattatcaatttcaaaatttgttttccaaccaaccccaaaatataccaaattatgggttttcaccaaaaattttcatgccgtcaactgttccaaactatcagccatattatggatcaataatgtcatatctatctcaagcacctctatattcctctattccacggaaaaattgtcctatagcttgggaaggacaatttactcggggagataagggaactagcactattagttttgaagcagttgcatctcatgatttatggatttggcatacctttttcgggtgtgcgagcacattgaacgatataaattttttagatcgttcaccagtgtttgatgacattgaacaaggaaatactccaagagtgaacttcttcgtgtaccaacgtcaatacaatatggcatattatctagctgacggtatctatccgtcttatccaacttttgtgaagtccattagacttcctcagagtgaaccagacaagttattcgtacaacttcaggagggatgtcggaaagatatcgaacgtgcatttggagtattacatgctcgatttaaaataatttggaacatagctgatttagctatcatcatgaggtcatgtatcatattgcataatatgattgttgagaatgaacgagatacatatgctcaacactggaccgactatgatcaatctaaggaaagtggatctagtacaccgcaaccattctcgaccgaggttctacatgcatttgcaaatcatgtgcatgctagatctaagttacgtgattcaatatgtacatcatgaattgcaagcaaattaagtgaaacacatatggacaaaattcggtaaataaaaagattttaaagtctttatgtttgatttaaaattgtgtctgtttcttgttttaattaagttatgtgtgttttatttaaatatggtgtctgttttattaaattgtagcgtttgtttattaatatattgtattgcaatttatgttttctgtaattttatttgtcttcataatgaatatatatattttctttatatattattgggaaaaaattaagaatctaaaatttaaatgaaaaaaaattgttaactcttaattatgttttatttaattttaatcgttaattgttattaatatataattataaaagtaaaaaacataaataagaaaaggaatataaataaaataaaataaaagtggggtagagtgtttaattttattaaacaaaactattgtaaaggttaaaattgaaataggtcttggatgattaggtggaagagagagaagctgatgtggagtaaaaaattgggtgttgaataagtaaaccattgtagatagtcttagtaactctattgtgactatttgcagtcttaaattagagactaacttgagacgactataatagtctcacattcgaaactattatcaaatcgtcacaatatagcaacttatatgtagtaccgacgttttagcgacaaacaacaaaaacaaattactcaaaaaaaacaaattatttttttaaatcaatcaaaaattaatttacaataacaaataactttatttatcacatatatatactcaatacacatctatatctatagattggaaacacttggtggacaaagcagcgatggtaggcggagaacaacaccatggcgccggcggaggattagagatgtgttggtgttttggttgtaacctgtcggaagctttgagattcaagaaccaaagcggaatcaaggaaagaagagataatggaagcagtgagcttccgtcatagtccttggtataagtttcagtatcgatcagagctgcaatctccttcaaatctgggcaagaaagcattctaagtaatttaatttcgaaacacataaaataaacatagtagcaatttgtagacttagacaaaactaagccatgcaaatggaaatttaccctatagcgttgaggtaggagtagagacgatagattgagttaaggtttgattatctttcatctccaaagtctggtacaagacccgatatctatcagctacaatatcttttaaatctgggaaaatatgcattctattgagatttgatttgttgagaaataattaaaacacatgtacatatgagttgggaaaactagaaatctaaattcgtagaactaacttctatgactcattgattaattgacggtgatttaatctttaacttgacgaagcgaagaaggtgacaaatagaaaagtgaggaagaagtgaggaaggaaagacgtaaggaagagaactggaaggaaaaaaagggataattttgtcccatggatgggttctatcaaggctgatgataatccttttgataatccttgtgaattatgatcaaccaattttgtcccttgcaatgagaagatttctatatattttattttatgtcataatttggatatttggaggttaatatttataaagtattttatgaaattttggtttttacagtgttgggattatatttttttaaacttaatatattcatattagcaaatatcttaataaaattgtgagagttgctaaatggtaacaaaagcgtcacaaattgctgatgttagtcacaaataaattacagatacagcttaaggagcgaacaaagtgtatgtataatgttataatcactcaaatgataatactaaacaacatcaatctgtttaatgagtataaacatgaaatatacaaaaaaaacataagatatttcaaaaccattagttaatactatataaaccttatgtaagtactcagaaattttgtttcatacattgaaaactttaagttttcttttgtattattatgatttagtatctttaattagtatctaaatcaatgtagaaaatttgagacttaacatattaacaattatctattggtaaatatcttaataaaatcgtaaggttgctaaccggtagcaaaacctcacaaactgcaaaaagcgtcgcaaataagtcacatatataagagtatttagtgactactttgtaacttttttccaaatagttctaaagtgctactcttttgtgacaatattttatgcgtcacaaccatagtcatataaatgtaatgcttaagaagcaaaaagcaaaaagtgtatgtctaattttgtaatcactcaaactacaatacgaaaaaaaatagtcaacttaatgagtataaacatgaaatatatagagaaacttaagaaaatttcaaaaccatgacttaatattacacatataacacttaattaagtttagaaattttgcataatacattgaaaactaagtatattttggtattataatgatttagtatctttagaagttcaaatcaatgtagaacacttgagacttaacatattaacaattatctattgataaatatcttaataaaatcgcgaaagttgctaaatagtaatataagcgtcacaattttccaatattagttgctaataagtcacatatatgtgggtatttagtcactactttgtatctttttctctaaatatttgcaaagggctactcttttgtgcccatattttatgagtcacatctttattcatgtgaattaaattttaagaactaaataaagtggatgtttaatgttttcatcactcaaagtacaatattaaacaagatcaatcaacttaatgggtataaagatgaattacaaagaaacttaagaaatttcaaaaccactagttaatataaagaacttaagaaatttcaaaaccactagttaatattataagaaatataaagtttttttggtatacattataatgatttagtatccatagtagtccaaatcaatatagaaaacttgagacttgttgtgaaaaagagggtttagagaactgtttttctctgttattgatctattcataagatacaacctatatatatataagatacaacattagggttaggtttatatatcaagtcatttataactaatgggccatataataggcatccacatattttacaatattattcataacactctgccttggatgactattatgaaaatgtggtctcaaatgtgcatgtgagacgatgatgcctcgttaaaaactttaccagaaaaacccaatgaaaaaaaccatgggtaaaagaaaaagagtgcagcgcgtctctactacccatcatgagtacatcacttgaaatcttcgagatgccacgatccaattatgattaagtaacttcttgagatagtagttggaaacgccttggtagtaggctcgccaaatctttacttaaacaattttatagacacgtacatcactattattcagttccttggtctcagaggtgacttgatatgagtcaaattaccctaatgactactttctcaaataaagaggttgttatacaacttagggatcgaattccacaaagttctcggatcacacaatagactaacagtttcgagttaagctaaacacaaaatattaagaaaatttaagacaagaaaacaataatagagattgtagattcagatgatgaaaacgttgggtttagaaaaattctcaggaaatatctgaatagtatatctagtagaaaattaagattattatcaaaccattctagatttcaaatcactattatagagtaaccggtggttcgccgcattactcactatgcttaatagtattgatcccaactctcttgtaattccctaaaactaagcaagcattataatccggtttgataagttttacctaagtatctaaatcgacgctagtctgcatctaaatactaggctcatctaaggtagttctgctcatatatgcctttttaagtactacctattaacctaaaatcaagttctaaataattaatctagaactagcattaaaaacaatcaaaattcaaaaattctaaatatataatcttgacagggtttttgattcactaattcatataaacccctaatgggaatccctaaacccaacaagagaactattcatacatgattatcaaagaacaaaacatgattaaagtagaaatcaatataagaaacaataagagaatagagtttagaaagatcttctctagaaggagctccacagggttttggctctcaagaacaaagtaaaataaagggtaaagaaaagttatcaaaagttattcagggttaggtctaaacaatgaacttaaaaatctatatataagttcctaaaaacatgcaagaacttctttgaaaataaggaaacattctacggcgaatttggaaatcttcaaaacttcagtaagtggcgagattgaattcccgttagatattggtgtcgctccacaccaggggtggtgtcgatcgacatctacgcggttttggtgtgcagattgcttctacagcataagttgtctgttttgctctaaaatgatccataatctccaaatgtatcccaaatatttaaagaccagaataagtctatagaacactctagaaataacaaaaagactgtaaacaccatacctatatcacaactaaaagcagtgaaaatcgagatatatcaactccccagacttagcttttgcttgccctcaagcaaaacacaaaagccaaatccgtggaagaggtttgaaaacgctggaactcccaacattctctagcctattgccttgatcattctaaccaaatccatatgcctagcacgtctaatcaaatcctaaccaccatttaattctctacaggcatacataacattctaaattccatacctaagttccacaactatatccaacaggctttcatcgttgagactcatcaatcaagctaatattcaagaaccttctagactcattcctgtactataccatgataaatcaaccacgcaatcattcctttgtattctttctctccccagacttattctttttggagattagacatcggaatactcgcttcattagataggtattataatacccctacccaggactaggactaggccgaggaattttagtcgacgatttagcaagccgcaaaatcggaacaatcgaaagaagttcttacgggacaagtattgtttcgtcggaccaactatctggctgttttggagatagtcatgagcaagtggtcggggaaccggatgggtgagtcaagaggaccgaggatttgggtgactgtgattaatgtgttgatgtgttgacggaacgcgtaaacccgtcgttgttacggttctacgagatgatcacagttggtaacggtaatgtccccgagtgcgtgggatgtgtttcatcccttactaggcgctgcttatgtactattttccaaacaagctgctatgtatttgtcaagcatttggatcatgtacatcgtgcttgatgatcggggattttaattgctcggaccgagcgtatgatcgagagtgttgcagttgtgttagtagctaggtagaatgagtggcctagaatctctctaaaaagtatgtgagcgagtgttgagagtcagatacgactagtttgtccagaggagcttccaggtaatgtcgaggatctgtcgagtagattagttaggcgattggaggctgagtttggattaggagtagatcgagtctaaaccgttcagccgaatcaaggtaagtttctatttatgcaggattgcggtcatgtggttacatgtagtcgacatactcatgataaccagcttgattgtttattttcttgattgtttattttcttgattgcttgaggttatgctttcaatcttgttatacttctgcatgctgcttgttattttgggttttgggttggggatttattgcctattagagggagctaggactcattaggcgagtagcgctcatcccccactctcttttgcaggtaaccttagttgtaaactttattttaagcatggatgttagggaagccggtttagtttttgcgttgactttgtaaaatcgtatttttgtaaactagtatgtatatatgactcgattgagcttcggctttcgtaccgaaaacctatacatgtatttggtaatttatttcaatacataatatatgaataagaaatcggcttttgttaaaactctcgtgtatcctctcattagtctagcccgtactaatcccaacttgcggtcgtagtacgggttgcaaagcctttaagtcatgtggtcgtgagggacggtcttttgtggtcgggcttggccttcggtgatcttttgtcagatttgtctgcgggcggtcgccaacaatacgtgatgctttcgaatttattcttagttctaggacggttcggggttgttacaaggttggtatcagagcatggttcatgatgctttgaggacgtgggatgatttttcagatgtttcatttagtcaaaagagtcgcaaaagcatttaggaaaacggtttcatgtgataggtttaggtagtttagttaggattacctttggatggtggttgcagatttatgaaggagagacggtcgtggagaccattaagctgaggagtgaagaggatgatgattatgatcgccggacacaataccctacgatattaacttatgtgtagcggatgcgtggtggtcatatcatatttaagtaagtaggcttcagtggtcttgcattccggcttgtctagtttttcaggagctagtggagcggcaaaccttcctaagtatttttataaggttaggaataggttatcctgaaattttcatgatcgtaagatcccattgaggtacgtatgggttctaacttctcttgttcttgtgcaaatgtttgcttgatttatgttttatattgcttgcatgttgattgttgaggaactcactgagtgtattagggaaaccctagctatttaggttagaacccttttagtcttttagtggttaccagagttgtctcttagtccttagaattggaggatgaattcttttaaaggtaggagaatgtaatacccctgcccaggactaggactaagccgaggaattgtagtcgacgatttagcaagccgtacaatcggaacgatcgaaagaagtctttacgggacaagtattgtttcgtcaaaccaacggtctggcagtttaggagatagtcatgagcaagtggtcagagaaccggatgggtgagtcaagaggaacgaggattgggtgactatgtgatatggttcaaattacctataactactctctcaaataagagatcaattgcagttttttaggatcgaattcacggagttcttttgttcaaacagtgagttaaatgtcgagattaagctagcaggatatgattgaaaataaaagagaacaaagtaagaaaacagcagattgattttgttgtaaacgatttaataaagagctaggaacagggtattctcacgaaactattggttagtagatctaatgaaagctaggttgtgatcaaactattcttaaactcaaactctaattatggaacaacaggtaggcgtgccgcgaaactccctatatctatagctaataataaccggagaagccgagaaactatcaacctaaatatgcattcttaacgagttcaattgttcatcttactagataggccgattcttattacacacctataaaccagactcatcaaataatagatccaattacagatacctatgatgggcatatctagtgtctggattcaagatctagttaattactctagatctagcattaagcatagatgaagaactctacagataacctagcagagggggcaatctactaaaccatatgaatccctaatgaaaaaccctattcctaacaagcagattactcagacatattggatggagcaaacaacataattgagtatgaaagcataaacacagtaatagagaaggggaaagaatggatcttttcactgtattaagatcttaataaaactctgaaaacaatcgatgaatagcttatgtctctcacaatagggtttgcaaagaacttgataaaagaattgataaaagaaacttaggtctaaaaatagtatataaaaccctaaaaacgtccagggactaataatacaaatagggaagtcttctggggtaaatttcctcttctgtaaacttgaaagcatcatggacttctgctgggccgaaactagtgtcgatcaacaccaagagtgtgtcaatcgacactcctcgctgattcctgaaccaaaatcgtccttagcttttgctccaaaatgtctccttatctccattgttgtcccattgcataaaatacctgaaaagacaccaaaaagactcgagagataacataacgactcaaaatcctatacctaaaacatggatacaatcagtaaaaatcgggttatatcaactccccgagacttagcttttgcttcccctcaaacaaaacacaaaagcaaaacccgtggaagaggttttgaaaacaaaggaactcccaacattctctagcctattgccatgatcatccaaactaagtccatatgcctaacaagtctaatcaaatcctaaccaacatgtacttctctgcaagcttacacaacattctagattccatacctaagttccacaactatatccactaggctgtcatcgttgggtctcatcaaataagccaacattcaagatccttctagactcattcttgtactataccatgataaatggaccattctttatataattggtcaacaatggaataaactcttaggaagcaaatttgctcaccagggatatcagttccatactgttagcgaaggtcaagaaggacatgtccaagagagtagtgagttctgaacatgttagctccattgccaaaggtcaaagcactgagaagctccccgatctaagtagcgtcgttcttgattgttcaatctctactagcagattcagtcactccttgtgtgatctgggatcaagcatccacctcatgcccaaatctattgctgagaggcaaggcatgactagctacatctcgacacggatcactctcctctacgcagatcgttccaaatgagtccatgaaggtatccttgaggatgttgtggtcttggcatataaggaagaacccaaggatcctcttatccttgatagagctttcctacctaaacttggaggtaggattgatgtgaagaagggaatgatatctctcaacatatgcgatgtggagatggagtttggcatggatggttcggaatctacattgcctattagtaacattgcaataaacaaggacaaacctcctaaggctgctccgatttcaactccagagccgactaaaaagcttgttacaactcagtcatagatgagagatgtagagaagcagtgtcgatcgacaccataccccctgttgatcgacaccatcgcgtttcacattcagatgcttctccacctcctccacagcccacaactgcttcagttcccagtgatatgtactcctctatctcttctcctactgttccttcgattatttctttagaattttttaaaagtgttcacaggtaaccaagcatcgagactctcgagcgcttgtttcctcattatcttgcaggagtgagtatcgatcgataccaacaccagtgtcgatcgaaacatgctactgcacatagtcgatctatttacacactaccttggaaggcgagattgcaatccgctaagcagcataagtcccttgtcactccatccacgtcctgaactccaccaagtcaagctattaactctaaaaaatcgcttagtgggaggcaaccacacactggtatgatttttcttttccttttctttaatttttgaatttttgattgatttttccagttctttacggatttgaatgccagtggggacagtggtgtttaagtctggggaagtgcctactaactatgcttttattttttgattcttattattttttgtttttatgttattgagtaattttctttttctaacaaaaaaaaataaaaaaaaaagcaaaagaaaaaaaacatttttatttagtctagttaggaattatgatctgtattttttagattaatgcctggttgattattgctgcaggtttgattcaatccgactattggaaaatccaaatggaaaactgacagacttgaggatatccttgtttccaacacaatccattaaggctgtagctaatctcactgctcttccttttacctcatcaaaacggttagtattcatagaacttgactccttgttcatacctgatatatgaaatcatatagaataagttctcttcccctctttagtaaaaaaaaaaagtgattgagatgatttcctgtagtgtataaagggttaggaatgtttcctttgatcttattattttacattctaaggaatgatcaattcaaaaagttgaaaaatatgcggaggatgcctatccgatgtagcgagtacttctttatcttatctctgataagaataagtctgggggagagaaagagtaaacaacaaaaagagaatggtcgagttatcatggtatagtacatgaataagtctagaaattttttgaatattagcttgcttgatgagatccagcgatgaaagccaggtggatatagttgtggaacttaggtacggaatctagaatgttgtgtaagcttacggagaactacatgttagttaggatttgattagactttctaggcaaatggatttagttagaatgatcatggcaatagactagagaatgttggaagttcttttggttttaaaacctcttccgcgggttaagcttttgtattttgcttgagggcaagtaaaagctacgtcttggggagttaatataaccctatttttactgtttttagttatgtttaaggtataggttttagagtctttttgttatttctaaagtttgagtctttttcaagtatgctatggattgggacaagaatggagataaagagacattttagagcaaaagataaagaaaataggcccaaggacgaattcactttcagatcaagtcaagagtgtcaattgacatactcttggtgtcgatcgatacaccagttgcggcccaaaaaagtctcagacagttcagagtttgaaaatttggaattttaccccagaagacgttcctatttacattattagtccctacaggtttttaggttatatatatataggtttaaggtcattgtttagacctaaggattatctaagaagttctaagccaccttacttgttctagtgcactttcataaagctattcatatccctgtttccagagtttcatcagagattttcaataacaatgaagagatattttctaactctttctctctcgattttgtttacgctttcttatttatacatgttgtttgtttcatccaccatgtttgagtagtctgctttttagggttagggtttctcattagggatttagataatttagtgctaggatatctgtatgattcttcatctttagttgttcttaatgctagttctagagtagctaactagaacttgatcttaaataataggtatacccaccaggtttataggtgtgcaataagaatcggcctatctacctaggtgaacttatcaaactcgtttagcatgcatctcttaatatagagattcaccaagccaacgatggggatctttagccctaggcatagggagtaacacgacacatcaccggttattcaataattagggtttgagtttaagaactgttccatcacatcctaactatttctagatctactatcatctatttcctaagaatatccgaaacctaacgtttttagtatcttgtcttacaacaccgtaatctgttatttgcttacttgctttctttttatttagttattatctagtcttacaacccctaactatttctagatctactatcatctatttcgatattttagcctattgtgtgaacaaaagagctttatggaatttgacccttaagtactaacgacgatctcttatttgagggagtaaacttagggctatttgacctacatcaggaggcatagtcttccatataagaattcaataggtctagcttttgcttactcgtatagaattaggtaaagcctaccctatataatgatcaatccggaaaaagcttaaccttttatttgatcgttaaggaaacatagcttaccatatatatataaagatcaaatcctgagaagacatagctttttaactattactaggttatgaacccacgctacgcatgggtttatttgtataacttttaataattttttgtgtgattagattttttattgaaagttttgaaagatatgtttttatatgtctacttgttgttaatattataaactctttgaattttaaaattaccatgacaaatagttacaatttaaatacataactaaaaataactttaatacaacttttacgtttacaacatttatcaaatgaacatttttttggttcatgactctctctttatctttagatgtttaggataacgacgttttttacgtatgaaataaattgttgtatggaaaataattttgacgactttctcatcttggtacccgcaaatttactattgtttttcgtttatcttcgctccattagttagtatagctcttctaaaaataagatattatctagaagtacattcataacctcatctacactttcttttaacaactcatacttttctgactgtcttttcaatatggatatgaatttctgtcttcacaattttttacagagagttatcactcttcctatctttttgcaagcactcgttttatttgtttcattttttcttacagtgtctctttccatcctcttatgatttgtctaagcaatatgtgtcaaactttctaaaattttcacatgcttcatattttttcttcgaatatctcttccttttcttgttagtataagcaattttcaagctcgtcaagatgtactttgttttgttttctgttattcaaagaaaatgttttagctgcggaggattagagatgtgttggtgttttggttgtaaactggcggaagctttgagatgtgcctcagattctggaaccaaagtggaatcaaggaaaaaagaaataatggaaccggtgagattccgtcgtagtccttggtatctaatttagtatagatcagagctgcaatcttcttccaatatgggcaaaaaagcattataggtaatttaatttcgaaacacataaaacaaacctagtagcaattggtggacttagacaaacctgaggcagacaaatggagatttacactatagcgttgaggtaggagtagagacaacagattgagttaaggtttgattatctttcatctccaaagtctggtacaagacccgatatcgatcaactacaatatcttttaaacctggaaaaatatgcattccattgagatcgatttgttgagaaataaaaacacatgtacatatgtgttggaaaaactagaaatcttaattcatagaactaacttctatgactcattgattaactgttgatgaagagaagaaggtgacaaatagaaaagtgaggaaaaagtgaggaagtaacgtgaggaagaaaactagaaggaaaaaaaaagtggataattttgtcccatagatggactctatcaacggttgatgatagaccttttgataatccttatgaattaggatcaaccaatgagagggtttccttattttaattttatttctgctaaattttggttatttgctatgctttttatgtcataaattggatattggtagtttaagatttataaagtatattatgaaaattctgttttttagagtgttaggattataaatttatttaaacttaataaattaatattagtaaatatcttaataaaattttgagagttgctaaatggttacaaaagcgtcacaaattgctgatgttagtcacaaataaattacatatatgtgggtattatttagtaaatactttgtaacttcttctctaaatggttacaatatgctactcttttgtaacaaattttaatgagttacaacactattcatatgaatatgcagcttaagaagcaaacaaagtgtatgtataatgttataatcactcaaatgataatactaaacaacatcaatcagtttaatgagtataaacatgaaatatacaaaaaaaaagcataagatctattcataagatacaacctatatatatataagatacaacattagggtttaagttgatatatcaagtcatctataaccttttagatctagaatatagtaatgggccatataattggcatccacatattttacaatattattcataacactctctcttggatgactattataaaactgtgatctcaaaagcgcattggagacgatgctgcctcgttaaaaactttaccagaaaaaaacaatggaaaaaactttggttaaaagaaaaagagtgcagcgggtctctactcctcctcatgagtacatcacttgaaatcttcgagatgccgtgatccaattatgatgaagtaacttcttgaaatattagttgaagacgccttggtagtaggctcgccaactctttaattgaacaattatgtaggacatgtacatcactattcttcatttcattagtctcagaggtgacttgatatgagtcaaattatcctaatgactactctatcaaataaagaggttgttatagcacttagggatcgaattccacaaatttctcagatcacacaatagagtaatagttacgaattaagcgaaacacaaaatattaagaaaataaaagacaagaaagcaataaaagagattggagattcagatgattaaaacgtcgggtttagagaacttctcagaaaatatttgaatagtagatctagcagtaaattatgaatattatcgaaccattctagaactcaaatcactattacagtgtaactggtggttcgccgcattactcactatgcttaatattattgatcccaactctcttgtaaatccctagaactaagaaaacattataatcaggtttgatactaagtattaaaattaagttcaagttaattactctacaactagcattaagaacaatcaaagatgaaaaattccaaatatattatcattacagggtttttgatctactaatttatctaaatccctaatgagaatctctaaacccaacaagagaactactcaaacatatttattcaatgtttaaaatagaaatcattggaagaaacaataagagactagagtttataaatatattctctagaaggagctccacatggttttggctctcaaaaaacaaagtaacataaagggtagagaaaagttatcaaaagttattcagggttaggtctaaacgatgaccttaaaaatctatatataagtttttaaaaacgtgtagatcttcttcgaaaataaggaaacattctgtagcgaaattgaatttccgtcagatattggtgtcgcttgacacctacgcggattttggtctgcggattgcttctacagcataagttgtctgttttgttccaaaatgctccataatctccatcccaaatatgtaaagacctgaaaagactatagaagactcttgaaataacaaaaagattctaaaaatatacctagatcacagctaaaagaagttaaaatcgaggtataacaacttccccagacttagcttttgcctgccctcaagcaaaacacaaaagccaaacctgtagaagaggtttgaaaacgcaggaactcctaacattctctaccctattgccttgatcattctaaccaaatccatatgcctagcaggtctaatcaaatcctaaccaccatgtaattctccataggcctacacaacattctaaattctatacctgagttccacaactatatccaacaggctttcatcacaaggtctcatcaatcaagctaatattcaagaaccttctagactcattcatgtactataccatgataaatcaaccattcaataattcttttgtattctttctctcccaagacttatttttttggagattagacaaaggagtactcgcttcattggataggtattgtaatacccctgcccaggactaggactaagtcgaggaattttataatttttgtaagaagttttttttttaaaaaagatttttttgtttgtaagtaaatattgtgatttgagttatgatttcttacacgttacgttggctattttccatcgtaaatttccctcgcaattcgcctgttttcttgtagtatattgttctcgctctgtcccaaaacagctccaactgtaaaatcacttccatcacacattatcttaaaatgtaaattctagtccggagtttgaactattggagcactcactaaagctttcttaatttgattcaaagcagcatggcagtcagaattgaagtcaaacttcacatccttacaaagcaaagttattagtggccttgcaatcttaccgaaatccttaacgaatcttctataaaaaatcaagcatgtccaagaaaactctttattgatttcacgctaactagtgcatgtaatcttgtcataacctctatcttggctttatcaacctcaataccagcacctgaaattttgtgaccaagaacgataccttcctaaaccatgaaatgacccttctcccaatcaagacccaaattcttctcttcacatctagctagaaccttgcacaggttctccaagcatgcttcaattgaagaccaataagcaggaaagtcatccataaagacttccatgaaatcctcaatcatgtctatgaagatcaacatctgttgtgattctcactttcactcatgttttgtgaattaaaacgaattagaagttgagagagaaatgcataaactctgttttttcttagaattttccataattctttcaaacacacatacattcttatcgcaaaacataaagtaaaacacaagacactagcttctaacacctacacgaatacactattgtaggccgctcccactacaagcatgcttactctagattatagcttaggtttccaaaagcaactagattcaaaccaacttctttcacatgtaactacttgttctctctttgacttcttcaatttggtttaaaagcaaaataggcattattcaacaacatcatacatctctgaaatgtcgcacgagcattgcaaagaccaaactgcattctgcgataggcaaaagtaccatacggacacgtgaaagtggtcttttcctagtcatcttgatgaatcagtttcttaaagaatcctgagtatccatcaagaaagcaatagtacttgtgattagctaacctttccatcatttgatcaatgaatggtagaggaaaattatccttccttgttgcagcgttcagcttcctgtagtcaatacatatcttgtggccgctaacggtccttgtaggaatcaactcgttcttgtcattcataaccattgtaacaactcctttcttaggaaccacatgcactagactaaccaaatcactatatgaaataggatagatgatccgagcttccaacaatttcatgatctcctttttaacaacatccttcagattcaggtttaatctcctctgatgctctactgagagcttacactcattcttgaggtggattctatgcatacacaagtcgggaaatatacttgtaatatcatcaagagaatagccaagagctttgcgatacttacgcagcttgcttagcaataaagtaagctctgcgatgtttgaagaagcattaacaatgacaagaagtggctttagatcaactttagaagcctattttttgctccaatcgccaactgttgctgctttagtagatgtgccaattaactcctcttgagcaaccaattgtattacatgctcagttctatttagcagtttaccatacccgtcgggaactttgtctattgaaggtataagagcatgctctaaaggatcagcaggtgtcatctccatgagaaatgcttcatctagagacgagatagtgtcaacatagaaagtctgcacatcgatggtaggcttcttaagcaccttattcatgccaaactacattttaagatcaccaacattcaagcctattatgcccttccttacgtcaaaatggcaccacttgtggctaagaaaggtcttaccaagattagaggatctttaggttctttctcataagataaaaccacaaaatctgtaggaatcatgctattaccgacttgtacagggacatcgcataggataccatcgggtatacggacagatcgatcagcaagaacaacagtgatttgcgttggctcacaatctgtcaaaccaaggcatagcgcaactgatcgcggcatcaaattgacaatcgaaccaagattacacaagcatcgcgcaaaactctcgttaagaatactacaattgagaacaaagctacctagatctggaagtttgtgtggaatcttattctgaataatgtcgctaatctgcgtagaaatcgtcatcacacctggctcagtattcaaatccttagtaaccatcctcttcacatactgtctaaccgtaggtgaagacttcacaacatctataagtggcatctctacaatcagcttatccatcatagctttgcatctagcattatctggctcttttttggactttggagaattcgctgtttggagaagaaaccttgggtttggctgcctactgaaatcgggttttggagaattcgcaagtctagactgggttggtgttgatggacacactgttggtgtcggtcgacgctgtcgatttctatagtgtctgcgttggctggtgttgatggacactcaatagtgtcggtcgacactcgtatctggtctacaaaaactacattttcattgtcttccaaaatgatgattttggatgtagaaagcttgctttgaagcactagatttagctgttttccactttgtaactgaatagcactaacatcttctatatccatactcaatcactctatttaattgttcaatatttgaatcttcccattcaaatcttccgataatgcaaccattttgtgatcaaaatctgtagtttgcttctcttgacctttgagaatctgtttgagcatcaattcagtcgtcttagtggtctcgtgtggagggtgggctagggttgaagaaagttgaaatgaagcttgtagattgctgaaacggtgtcttagatgaagatatctgaatgtagctcatgtatcccttttgatccatcttcactgaagtggccaaactgtcaacctgtgcagcatactgaacctgtaaattaccaagaagaaaaccaactttgatgactcttgctgactacaactttggtaagaaacacaatctaccttaatactcgaaaccgagtcttcaagtcgctcaatatgatccatcgggtgttcttgtgctagaccttggaaagggtgcatactcacaagcgtaaagaatacatgttttatctcgaaatcgcgtctttcatatgtaggtggtcggattgcagactgattggaatagaagagatctagtatgttgtagtcagcaagagtcatccgacgaccatctgcactgatttcccgttggtgtcgatcgacaccctcggcggtttctgatctcacgtttccctgtttatctattttctgacccttttcgttgtatgcctgactagctctatcgcgttacactccagcagcattaggtattactatcagcatcttgtagttgtgtttgaattccttaaactcctgaaacacaagaagaagaagaaataaaaacgcatgagtaacaaaagaaaaaaaaaagtttagattaaattctaaaatgtgatatgagtctaattaccctaatgactactctcacaaataaagaggttgttatagcacttggagatcgaattccacaaagctctcagatcacacaatagactaacagtttcgaattaagctaaacacaaaatattaagaaaataaaagacaagaaagcaacaaaagagattgtagattcaattgattaaaatatcatgtttagggaaattctcaagaaatatcttagtagtaaatctagaagtaaattaggattattctcgaacaattctagattttaaatcactactacagtgtaaccggtggtttgcctcattattcactatgtttaatagtattgatcccaactctattataatcaggtttgataagttcacataagtacctaaatcgatgctagtccgcatctaaatactatgctcatgtaagatagctctggtaatagatgccattttgaatactacttcttaacctaaaatcaagttctagttaattcatctagaactagcattaagaacaatcaaagatgaagaattctaaatatattatcctaacatggttttcgatctactaattcatctaaatcccaaatgagaatccctaaatccaacaaaagaactactcagacatgattatcaaagaacaaaacatgattaaagtagaaatcaaagtaagaaacaataagagaatagagtttagaaagattttctgtagaaggagctccacaggtttttggctctcaagaacaaagtaaaattaagggtaaagaaaagtaattaaaagttattcagggttaggtctaaacaaagaccttaaaaatctatatataagttcctaaaaacgtgagggacttcttctggggcaaatttaaaaatcttcaaaacttcaataagttgcaaaattaaattaccgtcatatattggtgtcgctcgacactaaggttggtgtcgatcaacacctacgcggattttggtgtgcggattgcttctgtagtataagttgtctgttttgctattgaatgctccataatctccaaatgcatcccaaatatgtaaagacctgaagaaaactgtagaagactagaaataacaaaaattctctaaaatctatacctagatcagagctaaaagcagtgaaaattgaggtatatcatgactcatcttgatcattatctttacttaccagaatctcatcaatgtatggcaaagactttgaataataatggtctttcatcatcagaatcacaatatttctctttatgtgtctatcattcgtatattatttgttgtctcgttaaaaacttttcatgaaaaaactcaatgggataaaatcatgataaggggaaaagagtacaactatgcacataaccatatttctctccctaaaatcattatcttcaagatatgcattcttatcatatatatcatattttaagaaatctttatattcttaaacttagtaaacatactcgtatgattgtcatataacctatcaagtcacttaacttctagtccataacatctcttttagatagtaaattatttctttgtctacttagactttatgtctaaattttttttacatatgatcttcaaacattaattttatacataggagtaattcatgctctccatataaaacttactattttagctttcctccttattatggtttttctggaccaaatataagtgagaattttccatggaaaattctataaggatatttgaaataagatctcttatgctggatttccaatttgtaattccgagaaatttcatgaagactcggattatccaacaatctgatttctacattttcctaaagaatgatctcatctgaaattctttcgtctgatattttactatatatgaaatctctacatgagactcgataatattgaagtcatcaacatattttgcacgtattgttgtagctttctttaacaagtatcaagtaaggtgattatcatatattcgcccgatgtttgaattcataacaacatcaatttattttcatacatatagtctcttgttcttgagaactagtatttgttgtttctggcaatataatcctttaatacagcttctaacagtttaagctttaaatcttctagagtgcttttataaatttaaatcattgtatgactaatacaagtcttctcttattctcaaacacatagatgatctaaatggttgcatccaccacaagagagtatatctctttgtaatcaatttcaagtctttgtaagaatcattgttactaaacataacttgtatctcatacaaatccacttacatctcataatgatcaacttacatctcatttagtttttacaccttcaagtgtacggaccaatagtccaaatactttttcttcaagatatttctataacttatttccttgattgaccaataattactgtctatatatacttttcaataaatctttctatcaactgtggtttatgatcctcgattttcctttataacattatcaactgcttcactacatgcaaaatgaattatgacgttagtttgcttttggttccattctattctagacatgactcaacttgttgagatttggtttcattatcattctcaagtacctgaatgtatttcttatacatgtataactctcttctagagatatttcataattcattgtttcctcggtgccatattaatttatgctccttgttcttttcttttcttttttgaggctgcttatattttggaaccaagtctctcacgcttcacgtgatctttagaattactagcatttgattatatccttctaggaaattacttttaattggagcacatcttgtatatgtgactttgtcactcaagatcaataaatgcttcttgcatgaattatctttttacttgttgcacattctttagtatgaggatcaagataaaattttccaatatatttctttaccagctgtttatttttaccccctaatgttggaaagactgagtcactgaaataacagtcttcattttgagccttaaatcatttcgttattgatagctcaagataatcaatcatcgagagagattcacattctttcaaatttcattttatatcactctggtggagcaactcaatatgtataacacaattagatagaaaatatctggttcctgacctaaaccaattgtaaaggagagaactcattctttattgttggcctgatgcgaataatttgacatagaatagtcatttacttatggcatgatttcaccaccattatcaattaaccaaatacacttacaaactacatgttgcaagtttataacaaaattatatagttgatgatcagtcaacaatatctcctcatatatgtaccagtaaattaacacgatccaaattcatgcagtcagtgaaagccatataatcagcttgctttatgaagcagcaacacataagaaatcattaggaaaaatcttctagatctctaatcaatgtttccataaatttataattattccttcgcatcactactaaccggaatggcttaaccgatcatgccaaacagtgaggttttcaataaagatttggcttactatacacaattatattttattaaagtaatctttatatagtagaatcatatatagaacgcatgtaattcctctaaatatattaaagcattagataatacttatgagttaatgggatttaacatttcttttagttgttgtctaaacatgatttatcccaaaatctcatagaaagattcatcaatcttaatttttttgtggacataatcttctggatgcttctcttattatggtatatgggattccttaactctctccctcgagatgataacagtaagtttatcgatttcgaattgaatcccatttagactcaataacatatcctacttgagtcatatattatatatttgtgacttacgagtatataatatacataaatatttcaataatattctgacaaataatgacaactatgtactcttatggagcattctataagtttcatactactttgtattacgcttttcttttctttgtcattatcatgccattgatctatatttttaattaattattcgattctcaaatagaagacattatgtgccaaatttgtgatcgtgaaatttctatcaatcagataaatatatatatatatatatatatatatatatatatatagattttcataagacataatctattcacgaaagtatacaatacttattagtatgctaatcaatgaaactagaaaagataatacttatctcgatggcgacattatccgaaattagacaccgagacctcttcgactaataatggttcgcctgtcctatatataatcatgttgcagtagcaaactgtgacaaaacaaaccagagaaaaatattaattttataaatttaactttcaaaatcggtaatttgaagcataaaacattaaaagatattaatcaacgttttaatggatcttcgtaataaaatatgaatcttggtgtaccaaactaacgatttactagaccaaacaattaagtaagaaaagcaatcagataatatatttttcttactagatccacaattgcataaacatggatcaatcattataaatcctataaaatgagatgcacaattataaaagatgaattgatccgttgttttatgtctcacatataaaagagaagtgaaacatgtatcatacatatagtaataattatgaatcaatatataagacgtgattggatcttctaagtatggatttataacgcaatgttaatattccaagatagattctttggtatgtgttaagatctcttactctaaaaggtgtcgacttcctctagagagacactcaacaaagacagaacagaggcactaaaacagagaacagaatgatggaacagagaactgagtgtgtgtgtgtttcagaagaacaagactagcaacagaagagaaaacaaaaacgaagaacacaggatttgttaatccagttcactcccgtaagggtagctacgtctgggccgagacttgcctcgggaatccactagaaatcagatggtgtttctttacaacaagagtttacaagtgacaacctaatacccttcactagtacttaggtcactctacactacccttgtaatccatagagaacaactcaatacaagtttacacaatgtaatgcttttctctcaagaacacctcacttcttttatttctctcacactctctctcttatcacacaagcacctattttatactccaagtaacaattagggcttcacttcagcaacaaacaagtagccgcctgcgtttgctaaacgccaactctaacaactttgaaaacgattgttgcagccactctgatcctgtttctcttttggacacacaagacaaaatgtccttaagcgcaaaacatggctatttccaggctgtctccttcatagccgttgcctcaagaaactggtcccaaaagtaactcaaccatggttcgacttaatcaaccttggttagtttcactcttcaggttgagtcaaacatttgaatgttcttgtgctacaagctatcatctccacaaatctccacctgatagcataagcagtaaacattcacaacatctagagtttagaaaagagagagagagtacctgattctagtttctggattccagtctcggatcctgagtccattactcagacttgactcggagcaagttcaaagcagcctgaaacttgctcacagccaataccttggtgaatatatctgccggattcttctcagtagatatcttcaacacctccacagtaccatctgaaatgatttctctgatgaaatggtacttaacatcaatgtgcttcgttctctcgtgatgcacattgttcttcgagagtgcaatagcactctgtgagtcacagaagatctcaacactcttctgttcataaccgaagtctttaagtaagcccttcaaccaaattgcttctttaacagcctccgtgagtgacatgtactctgattcagttgttgactgagcaacaactcgttgcaagcctgacttccagcttattgtgtttccaccaagtgtaaacactaaaccagtgattgatcttctcttgtcaaggtctgcagcatagtctgcatcacagtagcccacaatactgaaacttgagcttttcttgtaacacagtcttgttttaagagtacctttaatgtatcttagcacccattttactccaagccaatgctccttgataggttgactcataaaacggctaatgatacccactggataagctagatcaggacgtgtgccaagcatggcatacataatgctccccactgcacttgagtaggggacagacttcataaagtcttcatctctgatcagcttctgttctgttgcagcttggaacttgaaatgagctcccagtggagtcattgcaggctttgcttcagccatattgtaggtttcaagaatcttattcaagtaaccctcttgagacagccataaaacacccaatgtcctgtctctgatgatttccatacccaaaatcttcttagcagctcctagatccttcatctcaaaacgcatacccaaattagccttcaaggctgtaatagcttctttgttcttagatgctaccagtatatcatccacgtaaatgagaagatacatcactgaaccatcaggcaacacctttgtataagcgcaactgtcataagcacttttcacaaaacagatttccttcatgaagttgtcaaacttctcattccactgtttaggtgcctgcttcagtccatatagagctttattaagaagacatacctcattggctttgaacattgactcatatccctctggaggtgacatgtagatcttctctttaagctccccatgaaggaaggcagttttcacgtctaactgctccagctctaagtcttcttgagctactatcgaaagcaacacccttatagatacatgctttaccacaggagcaaagatctcatggtagtcaatgccctccttttgtgcataacccttcgcaacaagtcttgctttgaaccttggttcttctactccaagaatcccaagtttgtacttaaaaatccatctgcaaccaatgatcctctgattctcaggtctagtaacaatcgtccatgtgttgttcttctcttgagaatcgatctcttcgtccatagctagtttccacttgtcaaagtttgcatctaactttgcctttcggtaattctcaggttcaactgcttcaccgtcttcagttgtgtacaatgcttcagcatagtaatcttcatcatcgaaacgtcttggggctcttatctctcttttgtctctatcccttactaaatgataactcaaaggagactgatttacatcagaatcttcatcatcattagtgtcttgagttgtaggggtagagacaaccggactttctggtgcaggtatagtgttaaccatctcttggtctccacctgagataacatctctttctgcttcaagatcaaactccagataagatcctgtttgatcatcttcttctgtagaaacgttttcttgtctctgcatcagatctttatacacagcattctcttgaaagatgatgtttctactaaccacacactttctctcatcaagtatccacaccttgtacccttttactccaacaggataaccaataagcactcctttcttagctctaggttccagtttcccatcatctgtgtgaacaaacgcaacacagccatatcttctcagatagctgtaaactggaggatttccagaccacttcttgtcaggaatctcaaaatttagagctgaagagggagtcttgttgataagtaacactgttgtgtgagttgcctccgcccaaaacctcttaggtagacctgaatcactcagcatactccttactttctccatgatcgtcctgttcatgcgctctgcaacaccgttctgttggggtgtatacgcacaagttctatgcctatgaatccctattgattcacagaagccatcaaacaacttgttacagaattcgagaccattgtctgttctgagagtcttcactctcctatcagtctgattctccaccagattgacccattcaacaaacttttcgaatgcttcatccttagttttcataaaataaacccatacttttctggtaaagtcgtcaataatggacatgaagtattgacacttccctagtgagagcggaacaaatggagctccccacaagtcagagtggatgtactcaagcttctctttagtatcatggtgtgccagactgaaactcttcctcttggctttaccatagatgcagtcttcacatacatctaagcttgatacctttttcttatctagaaacccctttctaactagaatttccatgttcttttgactcatgtgacatagcctctgatgccacaagactgtatcatctgctctcttaactactgcaagtgattcacttgccacaggtttccaattaagcaaataaagcgtgtcataccttcttccagtcaataacacttgatttccagctttaattctcaatatcccatcttctgattcaaacttgtaaccagctttctcaaaagttcccaatgacagcagattcctgtccatgtcaggaatgtatctcacattagtgagaacgatagttaaaccatcactgttcttgactctgatggttccaacacctctgacccgagacactgtcttgtttcccattctaactgacccgcctgcatcctcattgaactcatgaaaccattcccttttataggtcatgtgatagctgcaacccgtgtctaatatccattcatcttctaaatggacctcagttgatgacaaagcttcagacacgtaatatccagctgcttcagccagatttcctttacctcctgaggactctcccttcactacttgactctgcttgaactgaggtttgttctggttaggacaagaagatctgaagtggccttcttcaccacaagtccaacaccctggtttcttcttggacttgcccttctttcctttaccctttcccttttgttcacccttccctttattctcattcttgtctttaacataaagaccctcagcctgaaccttgatacttttcttcactgagcctaactccaattcttttgagtaaatagctgcagcaacctcatctagagtcaatatagacttaccagagctatatttcaaagtatctttcagctgatcaaatgcctttggaagtgcagttagcagtaagatagcttgatcctcatccgagataataacattcatgttctctaaatctgtaataatttgaagaaactcatcaatgttaccttcaaccgacagattttcagacatcttgaagctgtatagcttctgcttcggatagatcctgtttggaagagctttcgacatgtatagcttgtccaaggctaacaacatagcagcagctgtcgattctttctttatcttccttagaaccctatctgtgacgctaagaacaatggcgctcctagccttcttcttcttctcttctaaagcttcgaacttttcaagcttttcctcatagtcttcatcagattcatccagaactgatttcttctcaccggtgctctccgactccttgagagcagtatttagacccaatatatccatatgagccaacagcttctctttccacatcgtgtaatcaccacgaccatcaaacttctcaacctctatcctagccgtagacatggttcaatgattgtgagactttacagaaccacaagcaataacctacagctctgataccaatctgttaagatctcttactctaaaaggtgtcgacttcctctagagagacactcaacaaagacagaacagaggcactaaaacagagaacagaatgatggaacagagaactgagtgtgtgtgtgtttcagaagaacaagactagcaacagaagagaaaacaaaaacgaagaacacaggatttgttaacccagttcactcccgtaagggtagctacgtctgggccgagacttgcctcgggaatccactagaaatcagatggtgtttctttacaacaagagtatacaagtgacaacctaatacccttcactagtacttaggtcactctgcactacccttgtaatccgcagagaacaactcaatacaagtttacacaatgtaatgcttttctctcaagaacacctcacttcttttatttctctcacactctctctcttatcacacaagcacctattttatactccaagtaacaattagggcttcacttcagcaacaaacaagtagccgcctgcgtttgctaaacgccaactctaacaacttgaaaacgattgctgcagccactctgatcctgtttctcttttcgacacacaagacaaaatgtccttaagcgcaaaacatgactatttccaggctgtctccttcatagccgttgcctcaagaaagtggtcccaaaagtaactcaaccatggttcgacttacatcaaccttggttagtttcttgtgctacaagctatcatctccacagtatgaaacattacaaatttaacatatgacaaagcaataacgatttcaataattaagtattacgatcgtaatttttgcatgaagatgttgtgtagccgatcataatattgagggtacgtagtacttatcttgataagttggattgatctaagataaaagactttgccgggaaatggatgcatcattgtttaaagattcgtgatttagatttctctttgttcaatcctttatattagtaaaaactttcgtttcaaaggagaaaaagaaagtgtttagttaatcatcataaaataataataagcatcaaataccaaatcgacatgattataattgtattgattaattataaagcactaggatattaaataccatatcaaatcagttggaagtaaattctgcatgaattttccaaatcaatttaatccaacgagtactaacaagtgacaagcatgagtgttatctggtaaatcaacaaatcagtaatagagacatgtgttaattaatgacaaaacatggtttggtaacaacttacgaattacgatggattcacgattaggtacacgaagggtgaattaacttatattagattagaatcttataggatcagagaaacatataataactacacggatctctttaacaagaagcatctaatagcttaccaaaccaaaacaaataatatattattcagctttaagaatccaaatactagctagcttcgttgataagatttagtaataacaaacagatttcatgaaacaatacttaaataagcatcgaacatagtagcaaacagtaaagcataaagttacctttctaatcttgtctttggcgtgattggagaacgtgaacaacgaacaaagtcgccgtcgactatagatttcgaagatatatttactagttcaggcggctatggtttcgtgccttgttagggttttactcaaatagctagaacttatgctgataacgtgttgtgaaaaaatgggtttagggaactgtttatctctgttattgatttattcataagataaatcatatatatatgatacaacattaggttttaggtttagatattgagtcatctgtaaccttctagatctagaatatactaatggaccgcataatgggcatctacatattatacaatattattcatataaaacttaacgtattaacaattatctatttgtaaatatcttaataaaattgcgagggttgcaacgttgtaagaaagtagttgcaaataagtgaccgtattagcaaaatagtcacaaaataactgttcggtgacactattttatgagacagagtatatgaattttgaagtttacaagtaaaaaaaatactacatatgattctacaatcactcatgttacaatattaaataagatctctcaatttaatgagtaaaaacctgatataaattaaatacttgaagttacaaatttgttgcaaatttgagactactttgtggctaaagcttccgactaaaaacggtgtttctaattcgtcttagtttgcaactattttacgaccaaaaccatatagccaacttatagtcttataacagtcacatatatgagacggtttaccaacaatattttttgtcatgattttgagacggttttccaactatattttgtgtagtcgttaatcagtcgcaaaaaaatcacaaaatagtcacaaatatttgtgactaaaacaatggtcacaaaatatagtcctaaaatgcaggtttttttgtagtcgcgctacaagaaaaccgttgtataatgactacaattatagtagtaaagaagtcgttaaactggtcattactactatttgacgattaaaataggtagtcataaatcgtagctaaaacttatagtcgttattttagtcgctaaatggcgactaattaacgaccatgtcgcatgaggaaattttagtcgtagattagtcgtaggtttgttgtaatatttaatgactatgttacgactaatttatgattagctcagttgaacatattgttctctgatcgtagtcgtaaatttgttgttggctttttaacgactcttttatgactattattgaagcctaagttgtagtagtcaatatactgacgataaatttggtgactaataagctacaatttgacaaccattttatatgactatgtgatgattacattcaaaatttggcatatttatattaatagttattttccgattagactatggttaactaaattgaaacacaaatcaaaaacaaaacaaaattatacagaaaatatttttgcacccaaacgaaagtgaagacaacagcattaagtatttgttcataccaaattaaacagaaatagaaacatagtgacataaagtttaagttcaaaaaagagttaagacatctcaacttatgaagcagatggaaatggagctgaatcttgttgctgaagagtgggtgtgatagggtatgtggttgtccatgaagtgcggatctgtttgaagcagatacatggtataaaaagagatcaggctagaagatcagactgcttataccatttatggtcatttacctatcttataattcataaatggtataaaaacatattttttttggtatagtagatggtaaatttgtaaccgttgtaaatatttttattattttatattttcaattggaaagaaaagtgaaagaaataatataaatattaaattaaattatcatatatctgtaatttcttcttttatacatgtcaaaatctagtcggtagacttgacatgtgtcacaatcaaaagagttacaaaatttggttttgaatgaatgttatggtaaaagttgagaaaacgactctatttttaaaacggacaacaaactatcgcagaataaatttgtctcaacgtaaaagcggtccgtagttagtccgccgcagatttgttatacttttttcagtccgtactactacagattataatttatgaatgtcaaacaaaaaacggccaaaccgcaaactgatttgtttgctttaaccgcttcaaacattcgataccttttatataataagatcttaccgttaccaacaaaaaatacaaaattaagttgaaacaatttacaaaaagaaaaacaaaaacatatattaatcgcatacacttctaactgaaaatgaaaactcaaataaataatactaaaaaatataatttaatttatttcatatttctaattggaaagaaaattgaaataaatcaaagaaatattaaattaaatcagcacgtttatataatttagtttctacacatttcaaaatctaatctatatatgaggtactaccttcgataatcaagctttatataatataattaattatgttttaaatataatcttaaaattatcagtctcctaaatcagtatatctaaatacaaaataatatataatataataaaactgagtactagaccacaaaaaataatctaagtaatacatatgatataaattaatatttttctactaactataacattatttattttgaaatataaattaacaattttgaatctaataaaaaaccagtaacacatgttacgtttacaacatggatcataatctaataccaattaaactgcatatagtttgtataaggattatgcattaaaagtggagtacaccatgcatatagaaattcgccgaataaaatcatatatttttcttgaatttttttttattcctatcatttatcaaattcaatttctcataaaaaagaaagaacatagagaaaaagcttataaccaaaaaatatgggattactaatagtaagtaatgaatacgagtgtatcacatgacgacatgtctcttcttgtcctttattccatctcattcattcatcctaccatcttcttcttattcttttttgctttttttttgcagcattccgctgattatatcatgtttttaccaagaaaaacgaaatcaaaaccgaaggagaatccaaaccggaactttctttttcttctttttatctttatgattccattttctccaacttttattgcttagaacgttgtcatgtgtcccattcgaataattgaaatgtcatagtagtttggcttagacggtgtagtgttggttaagattatcaatgtcaagacccttgagcttcactaccgactcaacgtggcctttgagagtgtgcacttctcttagcctgcatgcaccacaacacaacacaacacaactcttatcaatcttgtagaaaaatgtttacctataaatctttcagagtgatcaattttacatacctagcaacttctgcacgtttcttagcctgttcagcgatctcagagagctcggtgtaggttgccgtgtcttcgaacattgactccggcggtttaagtccatggagcgtacgttgagctagagcccattgagcctccctttctcccctaccgtagtctttcttggtcgtgaatgcagtcttagatcacaagaagggaaaacaaataatgtcaatatatatattttgtggggttttagaatcaagattttaattcacacataccctattttcaatcatgttgttccaagctttgccactaagggtatagcgagtgataaacttgaggatatcaagaggaatgtatgtgacgatactgtagatccagatgactccacaccatccccatccacaacctttgattctcgcaaattcccaatgcgcataagtagctattaaggttgcaatctgtacgttattgtgcatgggaaagaaaaaaactttagtagagacatatatatatctgaaatttctctgtgtgtatacaaatgacgtaccaattgggcaacaaagaaagcaataagaagaagaagtcccgggcgttcgacaaaggaccagctccttgatcgagtgacaaagatgagagcctgactaattatactgacttgcaaatacaatactgctattaattcctcgtctttgccttgtaacgaccttactccaaatttatcctacacacaccaacacaacacaaagatgatatatagatcataataataaaattaaatacttatatatactagtatatattgtatagattaccgagaagaaggttgtgtcatgggctagccagaagaagacaacagtgacgagagccatgtaggttccaagaacaactccagtagcgaaaatctctttaagcttccatgaatcaggaattggggaaggcttgactctatctttggaaatggtcatgatggttccgtcgtttaggattgcaataatgaggaccatgaagggagaaaagtcaaattcccaaataagagccacaagcatgaagccgaggactatacggattgtgatggagactgcgtagattgtgtagttcttcattctttgaaagatagctcgactggtgagcacagcgctgacaatgacactaagacctggctctgtcaagactatatctgaggcacttcttgctgcatcagttgcatcatcgactgctataccaatatctgcctttttcagcgctggggcatcgttgacaccatctccggtcataccaacaatatgtttcctttcttggagtttccttacaatctcatacttgtgctctacgcaagatcatagaattaggttagagacaaaaaagggacgaaaagtgaaatagaggatggttactctaccaggaaagactccagcgaatccatcggccttctcaatgagctcatcgacaggaactcctccggtggtgtcatctttgttttcaagtaaagaagaggaaggatacatgtttgttcccattccaagcctacgacctgtctctttaccaatagccaattgatctccagtgatcattttaacattcacaccaagatcaagagctcttctaatggtctctgcactgtcatgtcttggagggtcaaagagtggcaaaagaccaacaaactcccacggtgttccggcgctttctttgtccttctcaggaactctctgacgtgcaaccccgagtgaacgtagaccacgctcagcaaacttgtcaattatctcatgtgctcttctctttgtttctcctttgagatcacagagttcaattatctgctcaggagcacctttgctacatctatgccactctccattggtatcgatgtaagtgatcgcggttcgcttttctactggattgaatggcaagaaatgcacttcagttattccagctcttgcctcttttgggtcacccaacatgttaacaatggaagtatcaatcgcatcttggttctctactcttgaagccctagctgaaagtagtatcacatagtccttgtctacgtctttggagaatacctaaagaacaaagaaatccacaagacatgaagcttctaacgtaaccaatttaaaaacaaattatgatgatgaagagatttgtcttgaaacctcaatcaagttcttgtcaactgtaagtttgttgagagttagagttccagttttatcgctgcaaagaacatccataccagccatttcttcgatggcggtcattcgttttgtgatggcaccttgttgagacaacctatgtgatccaatagccattgtgacagacaacacagtgggcatagcgattgggattcctccaatgagaaggacaagaagattgtcgattccatctctatactttcgatgttggatcggatacattataattatctcaatcaacattcctattccgattgaacagatacagaagttaccaatggcggttaagacctgcaacatttatcaagaccatattagagttatatcataagattgcttgcatcgcaaggaaatataattcagaggtcagtcatatataccttttggaaatggccaacattgttagtactatcaacaagatgagctgccttgccaaagaaggtatgcactccggttgcaatgacaacagcctcgatctcaccttgtttacaagtggagccagaaaaaacctcgtctccctggtgtttagtagctgggagagattcaccggtaagagcagattggtcgatcttcagaggatcaccttctaggagacgagcatccgcgggaacaatgtcacctaacttgatgctgattaagtcacctggaactagaatcgcagcttcttgctctccccatctcccatcccttaatacctttgtttttggtgcaagattggccatgagagctgcagctgcattaccggcattgttctcctcgatgaaactgattgtcgagttaatgatgagcaaacatgtgattccaacaaagtcttgccaatccggtggcctcccaccgccatttgccaacacaatggccatgattgcggcagcttccatcacccatgaaagagggttccacataaaccctaagaactttagaaatttgttctctaccttctcttctagtttgtttgccccaaatatttgtagtctgtttcttccttcctctgaagacaaaccttcccgggaacatttcagctgttggaacacttcgtccaccggaattttctcctgtaatacatacattcatggtttcgtacgttttatcaacaattcatgttaaaactattataaggtaaaatgtgtgttttagcaacaacaaattacttacaagatcaacattctccttctttatttcatcccatgagatatcagcagccatgatgaatcacaatgatgagaaacaacaattttcacgaagctcggcttctttagacagaaaattaaaactctccttattctcttttgaattgtcttaaagaacaagaagagtaaaaggtaaaaataactgtgattatttctttagttttgtgatgtggtgtgaagacaaagaagtggtatatatacactttacacaagtggcttgcatgcggttttgtagtttgtggcagaccttaaactgaggtgttttgacaatgcatatgtgtgtgttttgaactgtttttatgccttttcttttgctttccataatttatgttgttgtttttttcaatttaaaatagggagaaaatagatttaggtttatttctacaaatagaaaaccggcattcgttatgatccaacaagaagtatgtatttaaatcttttgataataatatcaaataatccgaacttaccgaatgaaaaagttttacaaattttattggtcatctataaatagttaagaaaagatgatgcaacaagaagtatgtatctttatctatataataaagtaagatctcctcgaagtgatattctaagagcatctccaagagatactttatatatagagtatgtaaacttcaaatataaagtatgagtagtttcttctcccacggtatacttcaaatataaagtttctaaaatgtgtgttttgcattatagtccttatattgttcataataattttaaaaccatataacttttataaataactctaaaacatacattaaaatattacacataatcttaattaacaaaacaataaatttataaataaaatacatataaataaaaattaaaaatacataaattaacttataaattacaaattactcaacaaatttttttccgtaatgctctcatatatgatcaatcaatgcattacgaagacatagatgaatcattttatttataatctgtagattacaagccaaaaattgtcgaaatactttgaatatataaaaatttaaggactaaaatgataaacatagtaatttgtatatgaaatattgaattttagggacttaaatgcaaataaaaaaggtgaaacttcaaatttagagtattgaatagtgatactccaaatatagagtgtcactattcaatactctaaattatgaagtaatggagtatctcttggagaacctaaaactttatatttgaggggatagagtatctcttggagatgctctaagaagctaacaaatggcgctctattcattgcacatgtgtcattcctctcaaatttaatacactatttttatattcactttgtctaaatatagttttataataaaaaaaatctcttaacatttttgcaatgcccttttataattaattatttttctaataatgtatcatttatcagtatattcatatagttaccataacaatagaatttctcagcaaaataatttcccaggaattaaagaataaattattagttttataactttcaagccaaaaatcaaataatttttctctaacataagtttaaaggaaatgagacgtactcattttccggatattctgttcctcatggagacgaagaactccagtgattacatactgaaagttaagcaatggttaggctacgataatgttcatatcgtggatcctgaagggcattgttttggaaagcatcatatgaagttgaagtgctccgctcggacaagagaatcattgatacaaaagttaagcttgggtccttatggttttttgcttcatttgtttatggagatccagcttggcatttaagacaagatgtatgggacaatttaacaactattggtttagcaaggaatgatccatggtttgttgtaggcgacctgaatgagatatgggataactctgaaaagtttggtgggcctggtcgtgaagaatcttcctttattccatttcgcaacatggtacaagattgtcgtctccgtgacatacctttttctggtaataaattctcgtgggcgggtaaacgcaatgacatgtggatccaaatccgattggataaagctcttgggaatgctgaatggtttcatattttcccgcgtgtgcagtctgaatacttggagagaattggttcagaccataggccgttgataactcggtttgtcaatgaaaaccaatcatttattggtcgatttatgtttgacaaaaggtggacctctaaacctgaaaccgtggatattgttagacaaggatggaatagtgacggtatggatgagcacacaagcttatttgacagactcgcagcgtgccgaagatcattatccagatggaaaagagcctcacaatcaaattctaagacagagatcaagaagctgagagagtttttagaaacagaaggcagcaaacaatttcctaattactttctcttacataaatggagaggagagttggttgtagcttatagagaggaagaaggttattagaagcaaaaaactcaggaaaattggctgcatgatggtgacaagaatactaagtacttccatggaagtgttcaaggaagaagagcgcaaaataaagttttttcattaatcgatgacaatagcgtggagcaatttgcagatggatctaaaggtgatattgtagtaaattattttcaacggctctttacctcatcacaaccttgcaatgctgcggatttacttgatggtatggcacctcgggttacacctaccatgaatattgctttgactaaagaggtcactaacgaagaaattaaacaagcagtgttctctattaggagtagcagtgcacctggagcagatgggatgacgggattatttttttaatcctattggaatgtagttggacagcaggtttgtgaggaagttaagaagttatttgtttcacgatcctttcctgttgaatggaactttactcaaatatgcttattgcctaagaagccaaatccagatagaatgacggatctgcgaccgattagtctctgctcagtatcttacaaaattatctccaagatattgtgttcaagactaaaggtatttcttccagacattgtctctgacgctcaaggtgcgtttgtttcaggacgattgatatcagataatgttcttctagctcatgaaaaggttcatgcgctgagaactaatcgggagtgtaatgaaaattttatggcgctcaaaactgacatgtctaaggcgtaagataggttgagtggagttttttggaagagttgttttcccgccttgggtttgatagcaaatggataacatgggtaatgacttgtgtgagaagtgttacttattcggtcttacttaatggaaattcatatgggttcatacaaccggaacgaggtatcagacaaggtgacccgctatcaccatttcttttcatcttatgtgctgaagctttggttcataccatgaataaggctgaaacggaaggacgtctatctggtcttagactcacaaggagttgcccgtcaattcaacatttgttgttcgcgggtgatagtctatttctatgtagagccaactttaaagaaggcgctgaaattttaagatgcttaaaacttatggagatgcatctggcgaagagataaatcttcaaaagtcatcaattatttttggtaaaaagttggagccgattatgaagcatcttttggggctgtatttggggatcactaaagaaggaggagatggtatgtatttaggactaccagagtgtttcagtggatctaaatgtgatttgttggcatacatcactaaaaagctaaagactagattgactggttggtatgcgaagacattgtcgatgggaggcaaggaagtgcttcttaaatctgtggcaatggcattaccagtatatgccatgtcatgttttaaattgacaaagtatcaatgtcaacaaattactagtgcaatgacaagtgtctggtggaattcatgtgaagaacataagaagatgcattgggtatcttgggaaaagatgtgtaaaacaagaaaagaaggtggcttaggctttagagatgttggggattttaatcaagctttattagcaaagcaggcttggagacttcttaccaagcctcactctctatttgctcgagtttacaaagcaagatattatagacgtgatgaatttctggatgcggctgttggttctcaaccatcgtatgtgtggcgcagtatcattcatgggagagatttactcgaaaaggcctcctcaagaatattggtaatggacaatctacaaatgtctggattgacaagtggctattcgatagatatccgcgtcgaccttacaacaagcaatctctcattgatttagaactcatggtttcaaaccttattaacccccaaggctcttggaatcataatctcttatcagagctgttttttcctgcggatattgtcagaattatgtcttttccgccaaatcctggtttaccggacacttacatatgggcctataaccagaatggatattatacagtaaagagtggcaattggttgatttctcagcagaagcaagtctcgatacaactttccatacaagaacaagaagttcgagcaattaaagtgaagatttgggatattaaaaccattccaaaaattcaaatgttcttatggcgggctgtctctagtgcattggttgtatcagagtgcttaagagctcatggtatgaacattgatcttcgctgctctctgtgccaaaatgatagggaatcgattagtcatgtcctgtttcattgttggacggctcgagaagtttgggagagggttaacattcctttgcctactcatggtttctcacagtctgttacggagaacgtagactttgtcttgaacttaatgggtgacgatggtttatctccttctctgagaatggccattccatggttactttggggaatttggaaacatcgcaacacaacggtattggcgggaacacaaggtgatttaaatgcacttatagctcatgcttttgaagaatctgagttgtggaacaggttaaggatgatgccaacccagtctgtaaatcgtctttcgttgaatcctcgatgtgcagttagatggactaagccaccactagatacgcttaaatgtaatatccatgtttcttggctcaatgatgttcacatatgtggtggagcttggattgagaggaatcatcatggggatgctgtttttcatccgcgagaaatgtttctaccagcgtcaaatcgtattgcggcggagttgagaggggttttatgggtcttacacagtttatgtgacttacacttagataacattgagatatggtccgactgtggtgctgctatggaagccattagtgatcccataaattggccaaggtatttatcttatcttgatagaattcatcggcttcttccgaagtttggtaagctagtgtttagagtttcatctctaaaagccaataaaatagcacgagatatatccacgagcgtaacgagagaaggtaggagcagatcctatttggctcgaggaagtccgatgtggttacactcacatattgaagaagacaaacgaaattgagttttttggtgtggttcttgctatatgaagctctgttttttataagtgtatgagcatcttgctcagttttttctttttgagctgtaatgctctggttatagtactttttatcccatggttttaattaaaaaaacttcaagatataaaaaatatatgaacagattataatatttgtttgttgacaatatgatattttatttctctataataataatcataatcacaatttattgcatatatatatattctttaaaatgtaactcccaatattttacaaaagaagaataactcaacatattaattaatacacaataatgtattaactgtcctgagtggaaacataattttttacatttacaacaaataaaaataaaacacaaataaaattattaaaaaaaaaataatcatgataattacaaatattgcaaagtagtaatatagtttttacattatttgcaataataatcacaatttattgcatattaattgtttaaaatgtaactttcatgatgtttgaccaaattaaaacaaaaaaaaacaattaaaatctatggcatatttttctataaatagtaaggtaaaatcttcatcaaacatcatattctacctctcacatatatatatatatatatatatatataactaaaatatcttaagtttgtttttttcctttatgtaacttttgtaggttttaaaacaaaaaggtgagtcaaaattttggggcatatagagaagtgaacatgtgaaaggtggattttctttagaaatgacttgatgaagaagatctaaggcaccttcttacttttagataagaaaaaggtatgttctaaattcttttccttcattttctacttcgtcttcatgtttttaagttgagaaatgttgtttataaatcgtctattgtctttgttttttttattttttttttgttgggcagataaaaaaatttctattgtgtcaagttgctaaaaataatattaatctttaaaagtatattagtttcccaataaaaatgaccaaaagtgagtactcaaccaatgataaacaaatatagccaaatgttcatgggatacctaagatcttttttttatcattttttgatacctaagatcttttattgtatggttacttctttttgtctttttcatttaatttagaacttcaatatacaaacattgctcctactattttttgtcaagttttaaaaagtttgatctttgcaaatctagataaaactttatgtactacatatgttttagattattgttgtaagttgttatattgtattttttttattttttcaccccaaattagaattaattacttagatgtcatagaaaagtatgtttattactagaatatcatacatcttttaaaagttactcatatgttttgagcatttatgtaattacaattaacacccttgattagtttttattaaataatattatttaattcatttttacttaagaattaattaaataaaaaaatcattatctacatcatttaccttaatccacgtcattactcgaatccacgtcattacccaaaaattctcttaaaccttttggtttccctttttccctctacactgttcatccccgccaaaaaaataaactgttctatgtcgctcttttctctcgtttcgtcgacttgattatttgttcggaatcctaatttcgttatcgttctctatttatctcgtctcttctggctgaaaatccttcggtggtatcgaatttcaagtcaagtaaagtcacatccctatcaagtcgcatttgaactcaacttattccggtaagtgtttaaaataaatttttttggaattttctgacatctaagttcaacagcttgtgattcccgtgactaaaaccgttttttcaaaactgtgatattgagggattttatcgacggttattactgctgattttcaccgtcactgatttacatacggtggtttatttgttagatctattctatttgatggttgagttactgtttgtttcacgactgacttatgatttatcaatgcatctgtgtctgagtttgttatacagtgtggttgaggtatggttaatcaatgcatatgtggctgagtttgttttatgttatgactaagttatggtttaaccttacatctgtggctgagtttcagtgatgttgtggctgagtttattttatgttttgggtgagttatggtttaacctttcatctgtgactgagtttctgtgatgttgttgctgagttttttttttttttttatgttttggctgagttatattttcaatgcatatgtggatgagtttgttttatgttttggctgagttaatgtatgcttacggctggtttatgttttatcagatgtttgaagaccaaggaagggattaccctccaagactttacccagaaggggaatctaatttagagaataaagccattaatcacaacatcgagatgggagatttccctctgattagagaatcaattggacaagatgcatgaaatcaaatgaaagagacacctcttgaagtaattgctaagctagttgatagccattttgtttggtctgctaagattgtacattcactactcaataaatagttaaaaatactaaataaggagatttggtgtctcgtggcttgtcaacctatcaagtttaacttgaatgaatttggtcaaatcaagggttaaacacatatccactgcctacaaaatagtttgaacttgaagtggattacaaaacattcgtatgggaattcaatgtgccttgtggtgaaggtcctaagttagatgaacttaggcgtgacttagtagtgtgaagagcatggcctcctgaaaagcgtagatggttagggttattgactcttctagccaatggattttatggcttgcattttaaatctaggataccatttgagagtgccaaaagcgtttttgatgacgaagccatgaagacttatccaggcggtcggtcagcatttgaagcctttgttgattctataaagttgaagaggcctattggcaagtcgtacaccatcagtggtattgctttcgtgttacaggcttgggcgtatgattcaatcaacaccattggagagcgatatgggaacgtaatcaaagaggatgagattctgttgcttagatggggtgtcaaccgtacccgtgcaataatggaatcgaccattgctgaagatatcacagcgcatggtagtgaggtaaagttttggctctgttatgatagttacttactgagttatgttttgtgatggctgagttatgttttgtgactgctgagttaggttttgtgatggttgtgctattgtttattgatggctgagttatagtttagtaatgacttggttgtggtttattgatggttgaatcatagttgagcgatgtctgcgttatacttattgatgactgactttaaacatactaacgggttttataatctcttatgttctacatgcgtgtgcgtaaaatggttatgaaggatgctgtaagcgagctatttcatacgtggccagatgaagtagaagacccagcacttgatcacttgattgaaaacatacatggggataagtttgttaaaggctattgggatgtgaagaggaatgagaagaagaagaaaaacgtaaaggataaagctacggctaagacctgaatctcccgcaaaaaaagcagaaagtctatcacaatgagggtgttcaatctggtggaggagatgcacaaaagaagaagaagaagaagaaagtagctggtgaatctgatgaggacgaggaggatgttcgggaagatgtgtcggtcgtagatgtggtgtttaaattaatatctcccttaaactcaaggtttgacatcgttgatacaagcatcaaagaaatgtcctctcatattgagaaggtgattggagatcaagtagaagcgaggattgatgcaaagtttgaaagcaggtttggatctattgagaatgagttcaaacaaatgaaaaagcatctgaaggccatgggggtaggccacactgaccaaactgatcataattattctctacgttaaaaattaaagatctgtccaaactgataaggagcgagaacagctgctacgacaaaatcaacaaccaccaaaaggtccaaggaaacctccaaataacaactatgttactagtcttgcttcggtatgctaaccgctgagttatcattacgctctttacttatgactcagccaaataacatgattataactcagtcgtaagttaatagcgtattgataactcaacggtaattagcttatcagagaaggactagtaacagagtagttatttagaggtttcctaggaccttttggtgtttgttgattttgtcgtagcagctgttctcgctgcttatcagtttggaccagacctttaacttttaatgtagagaataattatgagtcagtttggtcagtttggcctacccccatggcctatagatgctttttcatttgtttgaactcattctcaatagatccaaacctgctttcaaactttgcatcaatcctcgcttctacttgatctccaatcaccttctcaatatgggaggacatttctttgatgcttgtatcaacggtgtcaaaccttgagtttaagtgagatattaatttaaacaccacatctacgaccgacacaactttccgaacatcctcctcgtcctcatcagattcaccagctactttcttcatcttcttcttcttcttcctcgtcttcttttgtgcatatcctccaccagattaaacaccctcattgtgatagattttctacttctttgcgggagattcagacttagcggctgctttatcttttacgtttttcttcttcttctcattcctcttcacatccctatagcctttaacattccccatgtatgtcttcaatcaagtgatcaagtgatgggtcttctacttcatctagccacatatgaaatagctcgcttacatcatccgtcataaccattttacgcacacgcatatataacataagagattataaaacccatcagtatgtttacagtcagtcatcaataagtataacgcagacattgctcaactatgattccaccatcactaaaccacaaccaagtcattactaaagtataactcaaccatcaataaacaataacacatccatcacaaaacataactcagccatcacaaaacataactcagtaagtaactatcataacagagccaaaaccttacctcaccaccatgcgctgtaatatcttcagcaatggtcgattccattgttgcacgggtacggttgacaccccatctaagtaatagaatctcatcctctttgattacgttcccatatcgctctccaatggtgttgattgacttatacgcccgagcctgtaacacgaaagcaacaccactgatggtgtacgacttgccaataggcctcttcaactttatagaatcaacaagggcttcaaatgctaaccgactccataaataagtcttcatggcttcgtcatcaaaaattcttttggcactctcaaatagtatcctagagttatgatgcaagccaaaaagtccattggctagacgagtcaataaccccaaccatctacgcttttcaggaggccatgctctccacactactaagcctcgcctaagtatctaacttaggaccttcaccacaatgcacattcaattccctgaagaacgttttgtagtccacttcaggttcaaactactctataggcagtggatctgtgtttaaccccgtgatatgaccaaattaattcaagtcaaacctgataggttaaccagccacgagacaccaaatctccttcttcagtattcttaactgtctacagagtagtgaatgtacagtattatcagaccaaacaaaatgactatcaactagcttagcaattactttaagaggtgtctttttcatttgattccatgcatcttctctaattgattctctaatcagagggacatctcccatctcgatgttgtgattaatggctttattctctagattagattccccttctggataaagtcttggagggtaatcccttgcttggtcttcagacatctgataaaccataaatcagccataagcatacattaattcagtcacaacataaaacaaactcaaccacagatgcattaaaaatataactcaaccaaaacataaaaaaaaaactcagcaacaacatcacagaaactcaatcacagatgaaaggttaagccataactcagccaaacataaaataaactcagccacaatatcacagaaactcagccacagatgtaaggttaaaccataactcaatcgtaacataaaacaaactttgccacatacgcattggtaaaccataactcaaacacaccatataacaaattcagacacagatgcattgataaacataaatcagtcgtgaaacaaacagtaactcggccatcaaatcgaatagatctaacaaatcagccatcgtatgtaaatcagtgacggcgaaaatcaaccgtaataattgtcgataaaaaccctcaatatcacagttttcgtaaaacggtttcagtcacgggaatcacttgctgttgaacttagatgtcgaaaaaatctaattaaagttagtttagacacttaccggaacaagttcaaatgcgacttgatagggatgtgactttactcgacttaaaattcgacactatcgaaggattttggccgaaagagatgagataaatagaaaacattgacaaaattagggttccaattaaggaatcaagtcgacggaacaagagaagagagagccagagaatagttctttttttttttttttttttttttgcacgcggattaaccgtgtagagggaaaaaggaaaactaaaaggtttaacgaaattttcgggtaatgacgtggattaggataatgacgtggataatgattgtttttaaattaaaaaaaaaatattatttagataaactaatcaaaggtgttaattgtaattatacaaatgctcaaaacatatgagtaattttttaaaactctatgatattctagtaataaacatacttttctatgatatctgagtaattaattcacccatttttaatataaaaataccaaaaaattagttttagattataattcataaaacctaataagtttttagtttaaaactaatatatcatagtcacaactcatgactaatatgaactactgaggaacaatgggagattagatcgcatagagttcaattcccgttctcaacccatgaccaatatgaactcaaagtttccttcaaaaccctcgttgctccgttcgatgcctaatttaatagggaacctcaaagcggctctatttcattctattccatacatatcccaattccattcatttaatatcattttggtgtcattgacataagagatgtaatttctagtctatctctttatatttatatatatgaaaagttgcaaaatcatcatataataatctagaaattgaaatagaaaagaaaaaagagaggtttgtgatggaatttcaatcttttatagtaggtaatctagtatccttatgcatgaagataataaatttggtcgttgtggtcggactctattgtggatttatgaccacattctacatagggccttcttatctcttccttctccgagctcgggttatggacgaaggagaagaaggaaccgagaagaaagtatcagcaagaacatgttttattacgggacagctcatgatgttcatatcaatctattatgcgcctatgcatttagcattgtgtagaccttatacaataactgttctagctctaccgtatcttttgtttcatttattatggaacaatcacaaacattttttttattatggatctactaccagaaataaaatgtgtaatcttcgcattcaatgtgtattcctgaataatcgcatatttcaattattcaaccatttcattttaccaagttcattgttagttgtggaagcccccttgcccattggttgactaagggttcattaaggcttttacaccaagaagtctgggttcgagtcttagatactgcggtttattagcaaatttgcagattaatggagacaagtgtgcaggaaatctccaacgatgtacaattatagcggttcaccaggattctacacagataagatcattgaaggtgtccatcaagagcatggagaaagagaagaaggtgtcgtctgtcgtggatctaataagggaggaaggaattgcccgtagtacaatcgtctatgtaacagttttcataatttgcaataaataataaatctaagacggcaaaaataagtttaatgttagctagattagtcaacatttatatgtttcgatacaacaacaagatgttatttgtaacaagtagtttcgttggttggttaattggtcacattttattcctgcaaagggtttggattggtattagtctcgatacaacaaaataattctattaggtctaatgtagttattagatctaataagtataagttctttgtgtcagaattgagaaattctatggctcgaatctttagtattctcttacttattatctgtgtctactagttaggcagaataccatcacccatttttactaagaaacttaaaggaacctcagaaaggggtgtgactaaacaggagcaagaggtatccattgaagaaaccccttttccttctatttttttgaaagaaggggaagatctggacaaaatcgataaaatgaaagaaatcctagtgaatggaaaagacaaaattaataaagatgatgaattacacgttcgaacatactataactataaaactgtttctgaaaaccaatatggaaataaagaaaattcgaatttagattttttcaaaaaaacaaaaaaggatcattaaaaaaatcaatacataggacaactataagaacatataagaagaaatgcgacttccacctatatattttgttacttctcctacaaaatattttttaatacctactccatttgtaattccatcaatgattcttttatcaaaaaaagtcgtttgttttgctaatcttcttatactttcaattaaagatgtttttaaaaaaagaatctatgtaaccacgattatatgaccaattatatacaaaatttaatagtttttcccaatgaatttgtttaggatttcattttggaaatgaacttagtaaggttaaatttaataaagatgaataaaaaggcttatataaacagtatgctataaatattccaaaaaggctatatatattgaccgaaaaagttgcatttctcaaaagttcataccaatctacaaaattttgtgaatttttatgcaaaaggtttattgacggcgtgaaatattttgataatatatcaaagtctattcctttttgatttaaaggaattcctatggttccaataaaaaggtaaataaaaccaaaataagcataggaaatagaacagtattgtctgattcatgcggataatagaaagttcttgtattaagtccacaaagagagagtgttcctattaaaatggccgtttttgtaatcgggacatgttttgtcaaaccacccataagaatcatattctgacttttatcgggagaatatccaactatagcttccattgaatgaataatggatccaaatcttaaacacaacaaagctttcgaataagcatgagtaatcaattgaaataaagcagatcgataagaccccatacctagagctaacatcatataaccgagttgagacattgtgaataggctaaacccgcttatgtctttttgaacaagagctaaagtggctcctaagagtactgttattatacatatcaaagatattatatacattatagaacggataacaataaaaagagggagaagatgagctacaacaaaaatacccgctgttattagcagcatgtataagagacgaaatgggattaggaccctccatggcatcaggtaaccatacaagaagaggaaattgtgcggatttaggaataggacctacaaataagagaaatgcagacaaagtaaagaataagagatttactcgtagacaaagtaaagaataagagatttactctattatttaaaattaaattattgaatatttcaaacaaatcctgagattcaaaactgcccattatccaataaagacctaaaatttctaataataaaccaaaatctcctacacgattagttaccaaagcttttcgacaagcattcactgcaataggtcgtgtgaaccaaaaacctattaataaatacacaacattccaactaattccccaagaaaataaacttggaacaaattagaactagtacctaacctaacattggagtattaaaaaaacccatataagcaaaaaaatattagatatccttgatcatgcgacatataatggtcactataaatttgtaacaccccaaaattcaataaaattttgagagtattactaaaaataatataataaaaatattaacatttcataatgtataacgtttaaaaactcattaaaactccaaatctcgaaagcaaaataatttaaatgtaaaaaatctaaggggatttgcaaaagtactattatttactaccattttgcaacaatacacttttctgttatccatttttaaaaataccccttctcttgaacaaaatgaccaaattacccccatctaatgagaacatctaattagaaaataaaatttctcgccagattttgactctcttgttttttttgttgtttttttagagacaaaatgttgagattgtaactagtatatgattgtaaaatcgattaattttggtcaacattctaggtaagtcaaaccggatcagatattattggtttactgatcagttcaattagaggcgtagttttaagaacaaatccgaaagcatatgtagttttattgagattaaagttttttggtggttttttcagaggcacaaagtttgggatggaatgttgagattgtatctaggataggattgaaaattcagtcaaccctatttttttcctcgacaaaaagttttttttccagccaaaaatgcatttaaaattcgtgtaacttttttaagaaccctttcaaaactcgtagaaaaaccttgtaaatttttttaaaagctatgtaaagttgttaaaaacccttataaatcattttaaaaccttttaaaatctttataaagtccttaaatatatgtgtaaataatatagatccccttcaaaaacctttgtacatcattttaacaccttttacaatggttttaaaagatttacaatagtttttaaagagttttaaaagaattaacaaggatttttaaaacctttgtagatccttttaaaatatttataaaactcttacaaagtctttaaatcatttttttactcttaaaaaagtttgtaaatattttaaaacatttgtaactctttttgaaccattttaaaattcttgtgaagccttacaaaaggttttaaaaagatttacaagagtttttaaacagttttaaaacccttgtaaatcctttcaaacccttgtaaaccattttaaaatattttaaatacccttgtaaacccttttttaatttttgaaccattttaaaatctcttgttaacccttacaaaaggttttataaagactaggtgatcacccgcgctaagtcgcgattttttcggatttttttgtaatgtttaatttaaatataatttttatttatctaatcattcactcatgcaataagcaattactttcagtattaaaatattttttttagcaataagcaaatacttttagcatcatacacataattcatcaacaacgtttgtcttaaaccaatttaactgagggtagtgttggattttagaaacctaagaatttgatgatggagctccttgcgtattcttcaccctcagtgatttattatataaatattaatttaagagaataacttactcaaatcattaagtaatccacgactattatacactcatactttgagtttgaattacaaaaaaaacatttcgagtatgagaaaactatcaaaagggttttcttgaaaaatcatgtaatattaaaataaatttagtaatagtacaattaaatatgtaaaattaaataataaatatgtcattaacctataaattagaagttgaagagcttacattaattatttaataaacacttggcaaatgataaagtgatgatgtgtcaatcatatggagaaagttggccaactttcatatatatgatttacaagagtttttaaagggttttaaaatccttgtaaatccttgtaaaccttttaaaaatcttttaaaacaccttataaatctatttccctccaaaatattttttttggcggaaaaatgtattttcgaaaaaaaactttggagggaaatattttttctaaaatttttggcaggaaaattatttcggaatattttaggtgggaagaatcaatatttattggttgatccaaaccatatactaacagaatatttacataatatactcgattgggatgttgacccctatcaaggtgataaggaactacggtccacaacattaaccaaccttaataccactaacagactaacataatgctaaatacatctattggcaatgctagccaccatagattgctcaatagagctagctaaatcagagtcgcatgctgataccagtcttaacagaataacaaatttcatcattagaatcatattcagaataatcacactaaaacaaataattcaaaatttctttctattttctctatatatatatttttgcagcacttttttgaagataatgtttgagatttgagccatcatttaacaattaatttaaatggatggatataacccggtttaactctgtttggatcttggataacatctatattattaattgggaagcattatgtgaactacaacattgtaagggtagtttaaaactaactaaatgatttttttgcatgggtaatttagtaaattaacaactactccaactaaataaatatcttgatttttgctttttttaaaaaccgaattaaatcaataaattaatatctacagaataattgcggaaatcatttaaaaacgtttccataacatatcaggctattttaatttgaattatatatacgtaaacttatttcttttggtaatatgttattagataattcggaaacttcaatctaatttaataacaaattctcatttagtttaaattttatacaattccttaacaaaactatgttaattgtttctgattagtacacataaaatttaatctatgatttagcatattcaaaagagaatttttgaattttagatttgtaattatctagaaaatggtttcagtatatatttaacattttaattagaatttaaatgatataaacgtttaaagtatttttttaaaaacaggtaattttcattatttgaaaaatatatcactaagctaaatttgaattatataaaagaaaatatatttttaaacgtattataatatttacaagcttttgaaatattcattcttctagattcgattatttcttttttttttaaacagtaaaagaaagtttaaatgccgatgtttaaaatttttaatgcaaatattcaaaatgagaacaatcagtaatatgattttcttgacagatcattaattgtattcgaacaataatgactaccagatttgcgataatgcataaggataagtttaattgaaaaacataccaacatcgttgagatctaactttagctttttaaaaaaatatttttgtcatcctaaatttaaaatatgtaattcagattagtcaatcccttgattttttaatatattacaataagaatattttaaaataataaaaataatatttaattttacggaatgaagttatctggtggaacgagtttgggttgatactcatacgggatgataatctacgagtgtaatcttagaattaacaattttaaaacaattatacaatcttaaacactaaacaaaagaaacaatattttacaaaacaactataacttaaaattcgaatttttagttacaacaaaattgaacaacggtgtaccgcagagtaaagtttacattatatcatctaattgatcaaattgcaaacaaaaacaataaatttgtatatacatcaaactaacaaaaatacacaaattttctaaatatctctatattatttcgcaaatcgaaacaaatctaacattcgatttactatgcaaaacacaaatgaaatataaataatataaattaataaaaaaatagttatagtatcataaataacactatacacttttctatgcacattataatttatacactacagtatctttcactaaaaatgtattccaatacattttttaaaatatgaaacctcgcatgtatgtgcgggtcagaatcatatctatactattaacaaaaattctttctaatgcctttttcacactaccccttttcaattctaccattttctatttaccatttttatttataccctatttaaatttttaatgaccattttacccctatttgtaaattgatttaggttaacaaaatgaaatattaatattttttgcctaaattattccaaaataaaatttcccgccaaaattttcgaaaaaaaaatttccagccaaatttttttttcaaaaacatttttcccgccaaaatatttcccgccaaaaaaaaatttagaaaacacttttcccgtaaattttctttttggcgggaactagatttacaaggaattttaaaagggttttaaaatattttaaaagatttacaagagattttaaaagggtttaaaagatttacaagagaatttaaaagggttttaaaagatttacaagggatttgagagggctttaaaagacttacaagagttttttaaagatttttaaagggtttaaaagtgttttaaaagatttaccaagaattttaaagggttttaaaagatgtacaagagtttttaaaagattttaaaagaaattataagaaaaccctttaaaaactcttgtaaatctttacaaaattgttcaaaaagagttgtaaatgttttaaatacttacaattttttttctaagagttaaaaaatgcttctgaagactttataagagttttaaaacgatttacaaaggtttaaaatctttgtaaatccttttaaaactctttaaaaactcttgtaaatcatgttttacccttttataagcttttaacatccttgtaaatcattctttacaacttacttatattttaaaaacgattgtaaaccattcaaacctttttttaaatcccttgtaaatcattatttgacacttacttatgcttttaaaatcccttgtaaatcattcaataccacttacttatgctttaaaacgattgtaaaccatacaaacacttttaaaatcccttgtaaatcattctatgtcacttacttatgctttaaaaacgattgtaaatcatgttttacccttttataagcttttaaaatcctttgtaaatcattctaataccacttacttatacttaaaaaaacattgtaaaccatgctaaccctttttaagaatccttgtaaatcattctatgccacttacttatgctttaaaaacgattgtaaatcatgttttacccttttataagcttttaaaatcccttgtaaatcattcaatgccacttacttatgctaaaaaacgattgtaaaccatgctaaccctttttaaatcctttgtaaatcattttatgccacttacttatgctttaaaacgattgtaaatcatgttttacccttttataagcttttaaaatcccttataaatcattcaatgccacttacttatgctcaaaaaacgattgtaaatcttgtaaaactattataaaaagtcttaaaatgatttacaaaggtttaaaaaggggttttaaagtatttacctatgtttttaaagactttagaaagattttaagaagttttaaaatgatttacaagagtttttagcaactaccaaagcttttaaaaaactttacaagtttttttaaaagagtttttaaaaaatttacaaggatttttaaaagcattttttggctggaaaaaaaatatttacgagaaaaaattttggcgggaaattattttttggcggaaaaaatacacaaatgtttataaatttgtatatacatcaaactaacaaaaatacacaaattttctaaatatctctatattattccgcaaatcgaaacaaatttaacattcgatttactatgcaaaatacaaataaaatagaaataatataaattaattaacaaaattagttgttgtatcataaataacattacacacttttctatgcacattataatttatacactataatatctttcactaaaaatgtattccaatacatttcttaaatatgaaatcccttacgtatgcgcggatcagaatctagttaattcttaaaaaagttaccattttctaataaaaaataatgaaaaacgaaatttattatttcgttaccatagttaatataaatataatatctgtaaactaaccatatttgttatttaccttatctaatttcctaaaacatctcaacctaattgaaacataaatatatgattcttcttttacttttatttaatcttatactttatttattttgaatttatataaaatatatatacattataaaatattatacttttttatgtatatgatgtaatttaaatttttaaaaatggacatatattatttaatcgatgaataaataatgtgcacaatgtcccacatcgcttagaaaaattgggcaatggttcagagccatcctataaaaagaaccaaaatgattccgattacgaatgagcaggaagcttgatttatcaggcgtccaaaattaaaatgattatccggtttactcgggttctttatttgaaagaattgaaattttaaaaagtttaaaaaaattagaaatattttaactttatcaaaagttatatattataattttcaaaactttttataattttaaagcttatgaagtttaaaaattataaattgaattttacaagaaatttaaatattataaatatatataaaagatattaatacaggacgatatagtacgggagaaatcctaatacaacaatcaaacttcaatttatgaagtttgggtcgatattatatatttttttcaagtttcaaattttaaacatattttaaatttataagaaaatgaaaaaattatgtttaatttcacgggacaagattatatggtgggacggatttgggtggataataatatgggatggtatattacgattgtacaatgtcccacattgcttacaaaaattggacaatggttcagagccatactataaaaaagaccaaaatgatttcgattatgaatgagccagaagcttgatttatcaggcgtccaaaattaaaaccgttatccggtttacttgggttctttattttaaagaattgaaactcttaaaagtttcaaaaaattagaaattgaattttacaagaaatttaaacattataaatatatataaaagatattaatacagaacggtagactacaggagaaatcctagatataacaatcaaaatttaatgatgaagtttgagtcgatattaatttctttttaagtttcaaattttataaatatttgaaatttataagaaaatgacaaaattatgttgaatttctcaagacggggttatatggtgggacggatttgggtggataataacatgagatggtacattacggagaaaaccctagaattaacaatcataatatacttactaggatttaacccgcggtttcccgcgggatagagtttatatagtttttaatcaagtaaactattgtatgttatatcacaaaatattaacatatatttattttgtaaagacttgtataaataattattggaaatttttattagtatggagactatttagagattagaagaatatgttttattgtgtttaaaattgtgtataaattacttaatgtgtatttgatataagtaaaatagttacaaaaatataatataactagattttaacccgtggtgtaccgcagaaacaatttatcttttcaaagttagtataattttttttttcaaattgtatctatctataatatatttttattttatagtttacaattgttattaagtaacgtcctgccaaacccgtcccgccaaacccgtcccgtaaaaaaaccatttatttatattaatgttgatcttatttatgatatgtttataaatcattgtctatatatttttgtcgatgcgggacgttgaacccacacattttttgccaattggttaatatatattcatttttaaaattttgaatcataaaatatgacggaaaaaattaagatttttttaaactctacatattatataatgatgttacaaattgtgatatattaaattttttataagtttaaatattaataatgttttataaattttaaatatataaataataatatttaaaaaattaatatgtttgcttataaggtaatgacataataactctaaaagaaaggatttagaagatttaaatctttaattaaatattttcattaataaataattaatgtcagtgacatgatattgtaaataagttcaaatacaaaatttatttatttaaacaaaaaacgtttagtaagaataatatttatttaacaaaaaactttgttttaaaatattgttaacaaatatgtttatgctaattttaaggaattgatttgaagtttgttgggattaaatttgattgataatgtgattgacaatttaaataaagaatttaaagtaaaattaattattttacaaattttttttaatgttaatggcattagatcgtaaataagtccaagtccaggatttatttgctaaaatggctgcaaaaatgtatatatagatggtagatggtgtaattattccgttgattataagagttgtaaaaaccatatgtagtatgatatattttttattttatgtagtatgatatattttttatttttgccataacaaagacaataatatttatcaggagttgtctttaaagaacatgttaataaaacaggtataatttttttttgttctttcgggattttgattttacacacaaacgaataaaccaaaaaaagagatgagaacagattctttttcaccactaatctccttcttcctcctcctcctctttccttcttcatcctcctcctctctacgtgactgtcgtgttctctaatcaatggaggctccaacgcctctcctccttctcttcctcctcacaaacaccaccttcttcaccacatccgtagctgacgacggaagagcaatgctcactttagctaaatcattcaatccattatcgtcagattgatcttccaccaccgatttttgcaattggtttggcgtataccagcattcgtgtcttccaaaaatgtaagtcaccagcgattgcccacattacaaatctctgttcaacttccaatgatttttttacaaaaatctcttgagctacaatgggtgcatgacaatgttgaagccgatagaatcagagcatttgagagaatacagacatctctggttgaattgattgctgattactacaaaacaatcgacactttctctaacattatcaaagttcaggtaattttgaatcttcttcacaaatttcttaggttatggttttggtatggcaatggtttatgtgttttccaatcagttacttcaattgacaaaaatcttgacggtattctagatattagtttgattgaatcggtgaataccctttactaaaactaagaaatttatacttgcaaagctcctagtttggttttgtctcattagtctaaccaaatagttatgtgaatatatgaaagagcttgactttattcattttttgattaaaattagtgctgaggttactcgtattttgctgattactacaaaaccatccgaaatttctcttatagtatcaaagttcaggtatttttcaatcttctggaaaatatatatttggttatggttttggtattgtaatagtttatgagttttccaatccgttcatcaagattgacaatacacatgacttcttagattttagtttgattgagttggttattacccttagcactaatttcgaaatttatatgttgcaaagctcgtagtttggtttcctctttgtactgctttatctcgtttagagtagctaagaaagagatagactttagccagttaattgtcttataacattgctagttaattgtttttcacgatttatgtgcagaaataagctgtgatacggcacctttaaatgcgaacaaacacatttcaattgactcgggaacatgcatgtttcttatttgtttctacccttataggagagagctaaaccaatgaattgattcacatatttttaatttagcagctgtcattaatacaaacaatcttataaagtcatgtcttatttgcaactctttttaatgattccatataggaatggtataaggcaattgacatgatgaattggtttatatattatatcataggtacctgagatttgttgttcataggtgttcatacatctcagtggcgtttaagtgtacaaatcgtcgacaaccaaatcaatactcatatatataaggttagttacacatcagctttcaatcaagtttatacaccatgtttttcgttggtagatttggttgactgaaggtataattgaataaagctttcttgtttttagcgttaatggaaatagatgatttatgctgtctagaaatgaaatctgttttacgattgtctagaaataaaaacattgttgtttgaaacaacaatacaaaacatcatatgaataaccaaagcaatgaaacgaattcctaaccccttaggttctgaaagatctctttgaaaacaacattcattgtttgactctgcgtgtttccttctttatccacaatgagcactttcaatccttttttggaagtgactcttgataaggcaacatatagctggccatgagaaaatactggcctaggaagataaatttcaacttctttgagtgattgtccttggcttttctttattctcatagcaaaagccacagctattggaaactgccttctcctcatccggaaaggcaattttgtatctgaaggtgatatctgtgcttttatgattatcactttgtctctgactctatctccagtaataactctagcttctagtatatgattacccatctgcgttacctgcaatctagtaccattacatagcccaccttttggatcaatattctttagtaacataaccggtgtaccaatcttcagagtgagattgtgatttgacaaaccagaaagctttatactattgaggaaataaggtgtgaagacgggattgttcaatgacgctggatcttgaggatcaatactatccgcacttaaataagtaattgattcacgtgtttgaaaacaattgttagaattcttacaacaaaatagtcttagtccacggcaattttaaacttagcttaccattaagtttctcgagcatgatgacaatatagctctctcttggaaaaatttaggatcattattaggctgcgacaaatcgaggtatccaaaatgctttggtaatagcttcaataggatcattggcatctttaataagtaactcttcaggaatatcgatgagaacttcaccatcattttggctctgaaactcttccatcaccaacggcaaggagccagttagagaattcttatattttctctcccttatctttatccaaatcattagacataagactcatattctttgtcaaagtgaggacattgcaatgttcccaaagataagatgaatttaaagcagctaaaacgatctctgccctaccagcaccatgtatcacatgaagtacttgtctgaaatcccctccgaaaacaacaaccttcccaccaaatggctttccatcaacatttccaataacatcatttagacttctatccaatgattcaaaacagtaacgactcatcataggagcttcatcccatatgatgagagatgcttcctttagcatattagcaaggtctgaattaggtactatatgacaggttgtgaaatcatcaggattaataggtataccaaacctagaatgagcagttctcccaccttgtaacaacaaaaaagcaattccgctagaagcgacattaacagaaattaaacctttcattctaactgcagcagatagagttttccacatgaaagttttaccggttcctccaaaaccgtaaacaaaaaaaattccaccactgttttctaaaacagctttcatgatctcatcataaatctctttttgctcagaagtcatcttattaaaccagtcatcatgatcttctttcagtttttccacgttataatttttctcttctgtaatgaaacggtttgaatgatcggtaccttctttagtaggtttaggcatgtgtttaaagtcttctagagtacttccattacacaacaacatatcttctatctctaaaagagcataatttattttctcagcatcacttagtactaaccttgaaaatagagaagaagataatttaattataacagaaaaataaagcaacgaactatacaaaataaatgtatctcaacgaacctggattgtcggactgctttcttttctttgtttcaatgtcttcgattaaaattccacaacattttcccacacatactctggtctagcaagacatttatccagaagcaacatagaaaataaattctgaagatgatccccaaaaaaaaaaatttccttcgactatagtatcaatatatgcttgatcgtctgtgagaatatcacgtgcaaaacatgcaaaaacatctttgtatgtctgtccacgtgccaaacatgcaaaaatttccttcgactatagtatcaatatatcaatatttccttgtatgtctcatacacaacatctttgtatgttctgatatcttcatcactctttggaccacatactatcccaagaagtatcttcatgtaatattctggttccatctttatggaggcgtagttcattcttcctatatagaaacctctttccctaagcttccactgcttattctgtccatcccatgtgaaatatggaggaatctctgtgtaaatgaactgtctagcaaactcacactcttgattcagtttcagaaaaccaataaacataaaatcttcgtttgcttttttttctgaaagttcatctatattctgagtgtcttcaaaacatagtggttgttttcctggtagatgatatgaaagcttcattacaggtgtagttctatactgaatgggaaatttgaatatcctccaaactgcttcagaagctgacacatatctatttagtaagaaaaatattagtaaaattgtagacgaaaacaaatatagatagatatattccaagtaaaaaagtatatcatacctgcaatcgaagtaatctttgatttctttatcgtcgtctatgacggctaccaaaagcttctgagaacctgaaaacaaaaccctaaaactgatttaaaccccaaatagaaactcaaacaagaaaaattggacatgcaatccctaaatcgattagaaaaggcacataaccttctcaaataagaaacagatatgtgactgagaagctgaggagtagcgagagtcgtcgagagagattgaacaaaactctgtagctgtgttgagcaagaacacgaacacaaagagagacagagagaagaagaatcgattagagcagaacacgaatagggaagaacacgaaccgagaggaagagaaagagtcgaatagtgttttttcacttagaattttttaaggctaatttttttgtttcggcaggcaacaaaaattaatccgcgctattacattaggtagcgtttaattaatggtaatgctatagaacaataaccctaaatccaaaaacatgacccgcgtcattttttatttcccgagtacgagattatagcgttttgaaattaccaaacgctataaaagtttagctgggttataaattatagcagaacatggttaactgctatattatagtgctataaatactcaatattcttgtagtgtctttacttttttctttgctgcgagtttctgagccagtctacatattagaagtcttgtccttaggttcaacaactatagctacacgatcttgtcctttattaatgtacttaaataagtatttgatagaaccggattgcttacaccactcaacgtttatgtgagccctataacgcaatgataacatacgattataaggaacaacataagtgttgtcacacttaataccccctttttcaacaaaatgttcagattctcgccttctatatattggatacccgtctttaccaactgttgtttgctcaaccagtttcttaggaaaaaacttggaacacttaccatcaacaatacatggtgactctttgttggcagcaccacatggaccatgtatcatacaatcattcacaacttcatataacttagggtccttagctttatctggaatctcagcagataggatgttgtcaatatcatcagatgttgggaatttgcaacttttatccatgaataagagtatatgagcatgtggtagtcctctcttctgaaactccactgtgtacatagctgcatattaaaaacgattttaaactctcttcattctagtaacagggaatcaaataaacagaatctaaacttatgaagaagatgatagaattaattaccattacagttttgcctagaagatggtcttctgttaaatctttcataagagagtcaagtttcatcttgaatatccaacacacaacatctggtctatcttcagcattaagtttacgctctttacagtaactagttatctctggcaacttggggttacatgtaaatgtaataaacaggtttgggaaaccatacattttacatatagccatagcatcatagtaagagttcaacatatggcgaggtccaccagtaaaagattgtggaattcggattgatttcccttgttcactcatgtttgtgtttccagcttctctcgcagccttaacggtatcataattcttacatctgagattagactggttaaacttaatataggccagcctattgctttctattgttgtgtatccatctaccaagaattgttggaacaaacgcttcgaacgtagtagggtctaagcttcatcagttctctcttgtattctaaaagcataccattgcctcatacttatacacttgtttgcttgttttcctgttctacctgtatatcccttctgtattcctggtctaaaatcatcttcaccataattaaaaataagaggatattgcattgggacataagaaggatgaactttgcttattcttgatagttgtcctgttttcttatcttgaacgataatatcacgtgtatgcattttaggacgaaagtctccaggaattaaagctgcaacttcagacgttctagggttacaataggttctgccatcttttcctaccctatcactaacaatttgcatataaaatggttccccattattactatccaacttatattttgctagcctgaaattttcaatgtatggattgcaagcatccaacattctgatgagcttttcaatgagatcctttctcacttgatttttgaatgttgctttcttcggattctttcccttgctaaacacagaattgttaagaaatcatattagtgaaaataccataaacttcaatacacaacgaacaataaaatgtaagaatagaaaatataaaaagtacctcatcacagtagatctgttttccacttcattcccagtatcaacaatataaagctgtgagaatttagcataatctccttcaccaggtaacatactaccaatcaaatgataattggctccatgtagctgaaactggttaggaccttttccctgtggattagatctatcaactttaccaccaagggaagtcatactgaatagcatgttgtatgctcggatattctcacggaaatgccttcttagtgcatcatcacaacttaacaattctcttataagctcaggtgattctgtaagaaatggcaatttaactgatccctgaagacaacatagagagaattttggtttcttgcttttccttcttttgttgactcgctcatcataccaactcatagcaccacagtattgacatttccattttggatcaccgtgatctaaataaggaatgtcaatgagaggatctgcaaaaaaaaaaaaacaaatcaaattcgattttaaaaatgttattcatatgttcgttctaaaactaaaaataattaaacgatcatacaaacctgttttccttttcctgtggataggtgctcctctagtatatctacttcgcttaggacttatatcttttctacctttaatacacggtgccctttgattctgtggatgcattgtttcatgtgtttcaacagaggtttcagtttcatatccagaactgctatcagaagccaaatcttcttgactactaacatcatattcctgttcgagatcagaaatatcttcttctgtttgacaacaatatgttattagtcaaaatcgaattcatatttcaaagaacaaatctataaatcacgattattaccatctaaagggattgactcaaacagatttacacgacagtcatccaaatctttagtctttttagtttttctttgtttatccggctgttgtgaatttttgactgttgaacgttcaggaaaatgaataacttaggtctgcaatcatatgaatattgatagaatacaatcattattattttcgtgatggtggataattgtatactcacggtttggtgtgacattttctttgttttgtgtagaatactgaattctgcttttaagtggctcacctcgtcgtcttctatcaggttggtttgatatgtctcctagaacccttttcttagttctattagtatttgaattcaatttcagtgtatcaagtttagaaacctgattaatggaatctaacaaaaaaagaacatagatttagagtgtaattacatattagaattaagatgaataaaagctcaaagtcagaaactatagcaaacagaaactcacgtttagtagattctcttcttatgtcggataagaaggtttgtgaaccaagttcagaataagattggcttattctgacagtctttatatttggatgattttctgttgcactgtatgctgaaaacagaatataagtaattatgttagaatgaaaaacaatagtatctaaacaaaactcatatacaaaaattgggtgtagacaaataatgctcacatttgattgtttctgatctgattgaagttagaaaatcgttgctgccaagtattgaagttgactgtttaattggtatatcagataatattgatccatcagttgttaaacattcaagaggttctacatacatttataaggatcgttttgagcataagttatgttttaaccaataaaacattgtaaaaatagtatgtcgatcaacataccagaagaatttatatattcctggcattgagagacattagatggcgtaattggcacagagcataaagaatatggttcttgagaagacaatgattgtctaacacaaacaggtgttagatatgagttctcatcaattgagcctgaaaaaattaagagaagccacaaacaacattgatgaaaatatcgaaagtcaatattatatagaactatattttagcctcttcgagagagaatgatttacctatatcagtcactgatagatttttagctaaaggagaaagagacccttctaaaaccacagaagtagattttgttatgtttgatatggaccgcgggcataaagagtattgttcttgcgaagacaatgattgtctaacacaaacaggtgttagataggtgttctcatcaactgaacatttggaaaaaaaacatataagccattttgtacatataacaaagtagtgaagtcttaactacatggataaatcaattagcatactgtagaatataatgatatacatgtataagattgtgctggaatttttcatgtaggacaaagagactcttctaaaaccataggcttggattttgttatgtccgtaattaaccgagcaaatattgatttcagtggaataacaaacccatttccagatgatttagctttgtggtgactatagaaactgtttttgctcgatgaacacttcctcttagcaaatggagtggtgtggttttcacctttatcaaccaaggcacttcttaacttcattaagctattgtttgtataacgatagaactataattttctaactaatagagtttaaaataaaacttagcgatgacttgaagattatataatcttttgttaagatatctaattaatatgattgcaattatatattattgttatattgattgccaaatcagaatattattgttaagtatctattatattctctgcatctaataatgatgttgttgtttttttaatttcaggttaatgcttagtctacaatctaatcaagattgcaatctgacgactgaggaacgattataaaggttagttcctcatcttcatccaatctttattagttgctgtagagaatctagagctattaacaacaactctataccgtatgcaaatttagatttataacgcattttctataaactttgccaataacatcaaactttgttaactcaaagggtcatgctgccaattactaaaattgcaacagagacaattgattcctcttctgagagagattgttgttttagaacagaacgacacatcttcatttgtttagataatgaaaggtgataagagtttagtattcaatgattttgaggaactaagaagattaaaaaccaaatggaaaaccaattatcatttaaaaaacagaaacaaatgtggaaacagtaaagaaaaaccacttattaaaactaaaacaacaaagcagaagcaaatgcaacatgaatactacttttatgtttactccatcggcttcacattaactccattaacttcatctgcgtactccctcttctgcttcccattcagaaattgagcttctcaccaacgactttagcttcattattcttttcaaccatctcctgttttatcttcacaatcttgattgagtcaaggcacagcttcttagttgttgaaaaattatcagcaggtgaaatggaagtgtcactactcctctttgaagatggagttgtagcctcagaaggctcttcagagtaggttagcatgaggctacactgagtctataagtagagtgatattagtgagttttcttaccaattagtggctttatgaagaaacaaacaatttaaaataatccatacctgatcaattgaatcatgcatctggtatctcttcttccccaagaccatcataagcaagaattctagataccttataagtatcgagttcattccacacattctcattctcaacacagaccagatactgataagttttaccgataagattcttgattgaatctggaaggatgtctgggtcctcaatctcatcgaaagatccatcaaggaggttatttgctggacaaccaacaatctcagaagacattgcatcaaaaagcatcagcttcatctcaccacttgaatccatcactttaacatgtagcttgtacctgtataggtcacaatatttaatccaataagccacagacaaaaatctttctatttttcattaaatcaagattatgagacataccttgcaagcacattggtgattggtgctcggcaagtttcacaccataactgtgctttcaaggaagtcatgactaccttagtcactttcttattgcacttcttgcagacaatatagtaccaagaccaatccctgtcaatgtcataaattgtacagagaaccttgaccctaccaacctgagattagacaattataagcacgattaaaaactatgataagtctaaaccaacgtcaatagataaagaaacaggatattacatcaaacatctcagagacttctttgatggtctttttagcaaactgaagatagaaatccccagtaggaaactcatcaattttcgactttggtttagactcaatgagagtaagagcaagacaatcttttggtaaagcgtctttaaattccagaatctcagggagatcaggattgatcaagatctgagatgtattgaaagcattggagatactcctaacatctacaaaacaaaacaaaaggatccatttcattaaatccgtaaacaaatatatatatatatatatatatatatatatatatatataaactttcacgatatagtcaatttagccaacatatacattctatataacttcctatataacctttgtaagtcttgagcttggcaaatctgaccaaacatatgatcatttcaccattagcagcttcacaggcagtgaaaacttgttcagcaaatgaaccccagagagtacatggtaacctttcatccctaaattaataatagaattattagaaaaaattcaaacttaatattttgtattctattactcatatccaagtaaacttacttttgatccctcagttcgaaatcaatcttctttgttggttgattgtggacatcaatagtctccatttcaccaacattcactatctgaccaaccacatctaatacaaaaacgaatcacagattcaaaaaaacgtaatggctataaagtttcttatttaaatggaaacgaaataagaagcaaaaaacataccaatcaggtagttttggttgagaccaccatttaaaacatcattgaaagcagtcaaggacagaaaataagaatctgacaatggatcgattctcacaacacgggtttgagccatgaatcccattttgtaacgatgatcagttgctttgaattgacctgttgcataggtcaatccaaagttttcaatagccctccactctcctggaacaatgagcctctcgaacctgttcaaatgctctctcttaactgaggcatggatcttctttcccttacattaaaaagcataaaatattagtatagaataaacgtttttatttgggaatattgtcaatttatgtagaaataacatgaatacttactctcacatcagagagaaccatgtcgaaagtctcaccaaacttcattgttaacgttttccaggtatgaagaacacagacttaaactctccaagacgttttgtagggcttgatgtcatcaaggtaagcaattgcttgagccattgttttgatttagttgctagaaaatgcggtatttgagtgatgaattgtgatgagaatggctttgatatatatagtggtgaaggaggctaaggttgctggatccaatatttcaaaaatattcgtcagtatcttggagtataagttgcaaatcaaagatcggataatgactaatgattcgaaattggtttagttcataataattggccatctatagataagtggttaatattgtttagttgattaaggttatttctagatttaacagtataagtttatatgattttctagtttatggaatgtattatcgtcaatgaggagttagaataaacgaatatgctcgtttatgtggatttatactgattattgaggagaatgaatatatgattgaagattataacaatcgtaattgaatatgcagaagattttgaaggaatatgcgtgtatcacttccacaaatattgttgagatatagaaataaacgtgttccgtgaaagattttgactaagattgcatttttgatggtccaccgaatatataggttttgttgtgatcaaaagcccattaaacataacacaccctacttaataaaaagcggatcctttttacttatgtttttggcttggacaattttaccctttagcatgaagaacaaaatccaaaattgaaatcaaaattgaggacaaattcgacaaaaattcaatttgtacttctcttttagtaataagaggatacaatcttaaacactaaacaaaattaacaaaacaaatacacttaaaatttttgattttttaaaacacatcttgattcttttataagaagtttaaatattataaatatttaaactttatattatgggtgaaattttagaatagactggtttgggttgataataatatgcgatagtatacaaggagtgaaatcctagaatgacaataaaaatataactatacaatgaaatactaaacaaaaaaaaacaatagtaacaaaataaatacatcgtaaaacttttttgttaaaacgcatcttgattctgttataaaaaagttaaacattataaatatttaaactttatattacaggtgaaatcatagaattgataggtttgagtcgattttaatatgggattgggtactacgggtgaaatatgagaaaaaataatcaaaatacaattatacaatattaaatacttaacaaaataaacaaatacactttaaaactttaatcttttagttataaaattttgtctcacggtgtatcatacatttaaatcaaacaatagcacaaatttatagatcatcctaaaaaaaaatctattattttttatttaatgaaaatataggcccgcggtataccacgggttaatatctagttcccaaatattatacaattatacatagtcttaacagaataacatatcttactagattttaacccgcggtataccgcgggacgattttttttttaaaggtaatatatattaaaacttgcaaattttatttttataaaatatttatattttacagtttataattgttattaagtaacgttatacgacgaatcaatgagacaattgttaaaaaactgaagttttaatccttattaaacagaatattaataatattttaaaattttataaatattgattcaaatacattcaccatataacccaattccaaaataaaacctgttctctaatttctttgcccatcccataatttttttttaaatagtaatttttaaaatttaagaattatttattatatataaaagttttgcaaattgtatcattctctaatacatttatattttatagtttaattttatatatagtaacattatacataccacataaaagtttttggttttatataacttttctaaattagaatgatttgatatgtttaataagtggtcttaataaaataataaattaaaaatttaacctgtattgaaatggtggattaattatattttacttttttattaatgttgatttaaaaattcgtccctccaaatccgtcttgccaaaaagccaattattttattaatattaattttatttatgatatgtctctgaattataatcttaacattttagctaataacatatgaatgcaccatattcatttaataggggaatgcaattataatcgaataagttcataaaacaatttaatattttcatattgtttataatttggtaacagatagatatttgaatattcggtatattttgcttctgtttaggaaatctttgatgatccgtctttagatacaataagccctataattaagaaatgaatattgtagttaaatgattttggtaaccttaatgacgtcattaaaggattttgtttttgattaaatttttctaatggcattgtcatgtaattaattacaaaaattaaggttacatttaaaatgtacttcccaaataatatagtaggattattataattataaccaaattaattatgaaagcaagcaaataaattttcagaatatacaaataattcatttattctttttatcatacacccaaaatattatacaaatgtataataactaataaggcagttaaaactcacctgaaaaagcttttaaaaccgaagacaattctatccacgctccaaatcaccaattaattcgtgtaaattcaaccgtgaatcaaaaacatatgtactatataccatccaaaagctaatttcaagttcaattgtattctagtatcgcgtaaaccagtttaaaactagttgaaccggtcctaattactaacaacttaaacacaaaactcaaccaattccaaattagatttcaaacaagtattctccatagacagaacattcaagaatcggttttaaaaccttaagaagcagcgtaaataaatcccgatttgactatgaaccaacaaaaagaaatatttaccgatcgaattccgataaactctgacttccgattgataatatgtcagtggcgttggattcttacgaacgagagatttctaacaaggtatagatcaactcctaattctttgtgaaaagagatcaacaattaaagagctttaaagctcattccatggaaaatttttgaaaaaaggtagaagatgaagcttacctagaactctgaagaaggctgaaaacaactcaatactaaagaaccaacaatagaagccataaccaacctaaacaaccacaaaatccgataacaaaatatcaacaaatattcaaatccgcattgaggcaaaatgggtctaagaaactcaccaaaagtctcaaattgataatggattcggcttttaatttcggtggagctttaaaacgcttatatatacgatatattagggttaaggaacaaggattcgacttgccaaaaacttcccttcagtttcgggaaagataaactggaattctcttctcttccacgtttttgcactttagtcctcaaatttttctctatttacagattccgcctaaatttttgaattgctcagaaatccttgtgaaatcagacagtttcaatacgttcaatttaatccaaaatctgatcctatattttcttttaattttgggtgttataatctacgtggaagaaattgtgagattgcatggtgtcgtgagtaccattgtctcacatcatgatccaaactttacttcacatttttggagtagcttacaccacgtattggatacgaaactacattttagtattgtttatcatccttagacagatggacagtctgaaacgactatacaaacactagaggatatcttgagattatgtgttttggatagtcatcagtcataggagaggtcattgtcattgattgagtttgcttataataatagcttccatgcgagtatcggtaagcaccatacgaggcttgatacggtaggccatgtcgtacacctttatgttgggcagaagctggagaaactactggtattggtcctgagttaatcttaggaaccactgaaaaattgaggctgatcagagataggatgaaaccgtcgaaggcgtgatttagaatttcaggtagacgatcaagtatctattaaagttcaacctatgaaaggcaaagttcgatttggacagtcaggaaagttaaaaccgcgttttataggtccttttatgattcacaagcgtgttggaagtgtagcttaccgcttagatttcctgttccaggaactcctgctgctcctggtggtcgagatgtccttgttccaagaactcctccttatgttcataatggttctcaatttccaccacctcctccaccaaatgctgctccaatggaggatatgtgacaaaggttccaatctttgaatcaaatgtttgctcaaaatgctaccatccagcagactttgttgtagcaactacctcaggcagctgttccacagccggctcagcatgcaaactctcagcctgactattgggtgttgcaagataggttcaaaaaggaagtcagcttgcaaaaatttaaaggttcttttgaccctatggaagctgagaaatgacttgatcttgttaaagaggctgtggggtatttgggagttcctaaggcttttaagttacgaatgattactcgccaacttgctagagatactcaacattggtggagaagcattgttacctcccgtcttggtgtggagttgacttgggaagattttcagggagcgtttatggatctgtacatcctagagtctgtcagatcaaatttgaggatgagatttgaggagctcaagtagaaagataaggcactaagagagtactaagttgagtttgatcatttagcaggctattagcgaaagttcatcgagaatttttctcgaattgcaaaacccctcacacaactactttgcaaaggagctaagtttgtttgtagtgagtcttgtgagcagaggtttagagcattaaagaagaggttaacttctgctctagttttaactattccgagacctggtgtagggtatgtgatgtacaatgatgcttctttatcaaggctgggctgtgtattgatgcaagaaaataaggtgatcgcttatgcatctagacaactacataagcatgaggttaactatcctacacatgaccttgagttggatgtagtagtttttgctcttaagttgtggcgtcagtatctttatggtgaaaatatgcaaatattcacagatcacaagagcctaaagtatttattctcgcagatggagttgaatcttagacaaagaagatggattacattgctaagtgactatgactgtgaaattcttatcatccacgaatggctaatgtggttgttgatgctttgagtagaaagcaagttacagtgacatctcttagatcgcaatggaatttagtagagcagatgagccagtttcacatttctattcgagaggaaaaattagggtttttggccacattgggtattcagtcaaatttactagcacatattcgtgattcttagtggcaagatggtaaattgggtactatttgtgaaaaaactgaggattttcgtcagctagggtataagcttagagatgacacagtgttatcttttaaaggtagagtgtgtgtgcctaacatacctatgttcttggaggagattttgccagaaggacatcaatctgggtatacggtccacctaggcagcactaagatgtatcaaacacttaaactttttttatcattggaatgatatgaagggtgatattgtagagtttgtatctaagtgtttggtatgctagcaggtaaaaattgagcatcagaagcgtagtggtaaactgcaaccatcacctatcccaaattggaaatgggagaaagtttctatggattttgtcacaggactagcagagatctatgtaacactccagtttcaggaatatagtgatgcatgcggagaggtttaaaagaattgatttggccacctatgtcaccaaagtgcacttatcttttcggtcaaacgtctttagagaactccacagttaagcgtgtttgcgctggattagtttcaggatggttgaccttctaggaagtgattgtcggaaccatgcaggtgaggacaaagcatggaaaaaaatcatgtggtgatttgtggggtcgttaacaagcctttaaagcctcctagacacggcgcaccgaccgtctgacaggggtgggcccatgggcctgagagagaacgtgaggcccactgttaagggcggtcgaggcgttacaaaatcagaacgaaaatcccaacaattgtaattaatattgacataatagaaggaagtgaatcgataaagtaaccgaactcaaaaaaaaattattatctatggtcccaaaccatacattttgatgaatgtaacttagaaaaatttgttaaatagatagatagattgaaagatcataactatagattgaaatgattaaaaaatattactaagttactgtcaaaaaaatttatttgtcttttcctttactactaaataaatttttattgtgattttatgcaaatataggaaaagtgaattataattccatactctcagtatagattatttaaatgatatatgctaattattattaaatgtattataaaataactaaatattatatcaatatatatatatatatatatattagttatagaatattgtatatttcactacattcattttacccaagaatcattgttgcagtgtgttactcgacctgttactcgaccacacccattgattggcatcaagctgtgttcgtcgaatatatttactgtttctgttagaatttatgttttctccctgttcacttaggactgttagaaacttcaaaacctgttcttgctttgtttgactctgtgaaatgtgattgcatcttgattgctagcatcacatttacaccaatttagattgacaccttaaatactgcaatgacataatagtaatagtaatgtgatcagaagttatatactcaagttatagatacttgattaccgtaatagttatatacgcatttgtttggtaaacgataactatttacacttgtttgcatatcacgttagtgtactaactatttatacatccaaaatactgtagaaattatgtttaaaggaacatcaaagattttgttttttggtctgccaaatatttcattaaaaacaaaagtttttagaaatttaatccaacccaattttcaaatatacttctcttttaatagtatagggatttattatacctttttggttgcattttagaagttttttaaagatatttttgtgccagtttctatataaaatttatatttaaaaacattgattgatttttttaattcaaatattaaatgatattttggtataagaaaaaggttttcatatgcctactttaagccaaaaatcttgtaaaatgggacataggaaataaatatgttatcttatggttaactttcaaactactcttggtaactgagtaccaaatagttttaaagtacaattttattaaaacactctcggtaagtagggcatgattggttgggctgtaagaaatttttgtagaaataacagattgccatcatcctctcatcgtactgcagaatctggttaatttgtgaaaattgacagattaactttgagattagttagtaacccaaggcttgatgaaactagtactgttttaagcattgcctacctcattttgctcatgtggttccattgcttcttaccggtttggattgctgttgataggactactactactcgcttatcgaaaagtttattactagctcgcactctcattcactcttgtttctttcttggttacactttagagatttattaataaatcttgttttaattcatccttctttgataatcatctttgctttgagattgaattgatgacttgactcaagaatatgttatgcttccctgctttaatactttttttggcatggaaccatgtaataggttatgtttcatgtaaccttaactttcatttgagaaatgaatatttacatttttacccaaaaaagatattttttgaatgttttaaataaaacaatatatatcttatatgtatatttaaaacaaggagtagaagttaaacattatgattattcaataatttaactaattaatactcgtgaacttgtttatttatatttttaaaaattagctgttactaaccaatcacaaagttaatatgtcaattttcacaatttaacaagattcagccatataagttttaatatcaacaactaaataacatgagttttgtttctatgataattaatttggtttttttttttgatgaactaaaaggaattttggattaaatcttgatcgcaatttgccaatcatcataattcttcccatcaaatatttcagaagcaatggaaactccgggattatcactgtttgtaaggtagtaaggtgaatatatgtataatactgtcatgagattcgattactggatttcgagtacgagctcgaggttcacgtgaaccttcaggagaagaatcatcgcgaattgccaatttacgagctgaaacaggaacgcggatcgtgcgatgattagaaattttacgtccatgcgccattaaaaaagctcttattttacggcgggggataaaatttgttcaactttttggtcgatgcaacaaatttctcggtgacgaaaccgaagaaactgttcgaagagaagaagaagcaaagaaaaaaagaagtcaagaatcgtatgaatgattcaccatgttacaagaaaatttgttacgaagaagaagataagaatcttatatattaaagcagatgtcgaaaggcttcacgttcgctctcagaaaatgaactgacggatttggccctcccctccacttaaggtttttaaggataaattagtctttttactaattaatgagataacatattattttaatatgtagaaaataaaaaaaagcgtttaattccctatcaaccctaaatttcctattctccagtgcccctaatcaaacctaaatattaaccctaatcaaacctactcaatcctaagtcgcccaacaaccctaacggacttatattatgcccgtataatttacgccgtcatatgtaaaaccctaaaatcttatgctcaaaattcctataaatataggatctctcctctcaaacacaaacatcgtagcttgattttagtgcatagcaatagcaatatggtttatagttcttttttgtatttcaatcaaggtcttttctatgatgctcttcatagcaatagattttttcgagtcctttttatgttatggtcaattggaaagtaagatctcatagtctttgccaattggtgatgagttgtttacccaaagtttatagtttgttcgattacatgttttggatctatcgtcgctactatatgatataattattttggaatttctttcttttaatgttagtggatcgatcccgtctttaaagtgatggtgtttgtgtatgattttgcaagttggtgtttatgcaacgtcgtaaattggtgcaactaacaaaatctccaaaaaatctgagggtttgtttaatcctgcaaaaaggtagtctcttatctaactaaattttctattttatcatggatttagtttttgctttttttttttctggctgctataaaccctagcgttcgaattgattcacacagatcatataaacacatcatataaacacaaacattgtatgtaagttattgattttgtttatagtttgttcgaattttttgtttatcattggttttgagaagaaatatgcatgaaagtttgtcaatttagctgaaggaacgttattttgttgttgtgcagtcttagacattgaggcggtaggaacattcaacatgtgtcacgcagctctcaagtatcttaagaaagtagcgcctggaagagactcatcaagcggtggcggttcgattattaacataagcgctactttgcactacacagcttctaggtatcaaatacatgtatctgcagccaaggtaatttgattagtctgataaagtcattcagtgtctcgagttttggttcggaaatcaagaactaacttaaaggaacaatagaatgtagcaaaatgtgatcttaggagtttgaaacttgaaacaggttgcagttgatgctaccacaagaaacttggcattggagtggggaactgactatgatattagagtgaacggaattgctacaggtcctattggaggtacaccgggaatgagtaaacttgtacctgaggagattgaaaacaaaaccagagagtacatgcctctttataaacttggagagaagtgggatatcgcaatggctgcactctacttgagctgtgattctggtatgctgagttaaataaagcacactctttagtataaaacatatatagatggttagatgacgtaactcatttcttgatttgtttaacagggaaatatatgagtggactaacaatggtggtagatggaggactgtgtcttagcaaacctcgccatttggccaaagagtggagaagaggtctagggccaggcgaatgattattactatgttttggtgcatattgtacaaagaatgtagtattaaaaccaaaaaagtctttggtgctttggtgcatattaattatacaagaaaattctcacaacgtctacgaggaagcaaaaacgtctaagcctaaccaagatgaagtttcagaccagtctctagctctgaatacgtaattatggtcaaaactcaaacgtatggccgagctagaagaaaagtacaagtcccttgactcaaaatcagcagaagatgttgggaatgtcctgaaatcagttgtactttactctagttaaagttgtaatgtcgaggtttgacatttgtataatattaggtggttataatgtgttgctagagaccgcttataatctatgagtcagaactcattgctaatattatacaaatctacagggtcacacacctaagcaaattggatcaataaaaagatttattgcgctttggcccattattaaccctaattgattagggttaaacgtttggctatatatatgatatattaacaatttttgtgagatacacttttgatcacaagaaccataaaataaagagacaaagagttgtctaaagttttgagattaaatcttaaaggaactagcatttcagatctgatccagtttgtgtgcgtgtggatactagtagaggcacaacacttggggtgctaaaataatctcgagataatatggttcacctttgcgctgcagaatatccaggtatattcaaacccaaagatctaaatttaattctttatttacacagttcctggcaattgaatttgtttttagtatttattaattgttataaaccggtacgtaattccttcagtggtatcagagcctatgtgtttaatattgaatttgaatctagtttaatctatattataatatagataaataattgttatttgtttattatgatgaaatttgtgaaatttaatttgttaaacatggtagaaacgaattcgcctaatagaacatgaccgttgtatttttatgggcagcaaacgaaaccaacttcttccttgtagactatagatttttgtttgaaacccctatatttagaaaattttgttgcctgagaataattatttatgtatttgtaggaggtaatttgacatatcagaccactgtaagaagagagctaacggacctaaatgtcccgaaacggcaagcgtattcagggtgtaagtagtctctgattcatatctctctgatttgatttggtacagtataaaattgtctacttttttttatttttgattgactcgtattgattgtgtggaggttattgtattgattgatgcgaatgtagtagttttttttttttttttttggtcggaaaacgggagaagtctcccgctttattattcataacaaaagaaaaaagaactacaaccgaacaaaacgtaaccttgagaccccattggcatcttccaacaaaatcggattaacaatatccggtggaagattaaaagaatggaaacctaaaggtctttaaaaaacatagttcgctaacccatccgctagacggttagcctccctatacacatgtgacacacggactaaccagtcccttgataaaaagccatagcacaagcgtactaggaacgacagggggtgagagtcactgatccctgaagttaaaaaccccaccacaatctccgagtctacctctagctccaacctcgcgacccgcctctcccaagctatgtaaagtccatagtagaccccccacagttctgccaaaggagctgtacaaatcccaatattaagcacaaagcctccaatccaattaccttcctcatcccgcaacgcaccacctgcagtcgcctctccagggttcccatgcgacgccccatccgtattcagcttgacccagccctcatttggtttcctccatgagacttgtcgctctacctgcacaatctccttcgtattcccggagagctttaagtgagcagctgaaacctcatttgccaaatccttaatgaaccgtaatctatcccgacagcggccaacctctcacaaaacatttccacaacgccacttccaaccccaccaagttgccaatgcaaaaactgtggaccaaacactgcctcccatctcaccgtgttctcccagatttacatacagccactcaagaatagacttctcaaagaaaaggcgttgtttgctcaccgagataagccgtagccatattccttccattgcagggcaatctctgagaacatggataatagactctttcgctcccttacaaacttgacagatggtcgtggtactcaaatgtcgacgatgcctttcttgattcgtcataatggcttgttgtgctactaaccagaggaagagtctcactctctcaggcgcagtcacgctccatactcggtcaaagaatctcttcatatcttgtctcggcgcctcatctctagtaagaaaagaataggtggtgctcactttgaatctcccatcttgactctccccccacgatattctgtctctagctcccgttatatcatctaaaacaaacgattgtaattgtaatctgttataagaagatatatatggagctatcgtcgccatatcccaaccgatcccatttctcctaagatccctagctcgcattcctttccaacccgccggaggctcctgaaccaacaactcagctagaggaatatttgttagccacttatccatccaaaacagaatctcccgaccatctccaatcacccaacttaagcccgggattaccacctctctcatacccaacgctacacttctccaagtcgatgagcagacacttctaactttagtccaagcaccatcccgaacatcttgtactctgtagttacatctcatgattctcgcccataagctatgataatcctgaattagacgccatcctaccttagagagaagagctttattcatatcctgagctttcctaattcctagcccaccttcactcctaggcttacaaactcttttccaggaaataagatgctgcttcctttgagttacagagctgccccataagaaagatctagacactttgtctaacccatccaacgttgatttcggcaaagcaatggtgctcatggtgtgaaccggaatcgacgaaagcactgccttggtgagtgtaactctccccgcaagactaaggaatctgcccttccaaccagccagccttgttgtcaatttttccaagatatcaccgaaagtgtccttattaattctcctctgaaggaccggcattccaaggtattttccaagctctctagttgagctaatcccactttcatcgcttatcaacttccccaagtcccgagacacattttcagagaagaagatcttcgatttctctaggctaactttttgaccagaagcaacacagaaacgttccagaactcgtcttatcacccgaatctgagccacagatgcttccgcaaaaaggattagatcatccgcgaaacagatatgtgaaagctttggtccaccctgagagagactaatgggtttccaatctttccgagcaatagaatgctctataagatggcatagtcactccatgcaaagcacaaaaagatacggtgacagtggatcaccctgacgcaacccccgttttggtctaaacgcttctgttcgctcaccattccacaataaactcattgatggctcagtaacacactgcatgatccatacaatccacttctctggaagcctaactgcccgtagagtatcctccaaaaattcccagcgaatccgatcatatgccttttctaaatccaatttcaagagcatccaacccttacgcccttttttcctcctcatcgaatgaacagcttcttgcataatcactatattatcagctgccaatctacccgaaataaaactagcctgagccggcctgataagcttcgatataacccgcttcaaccgcatcaccaaagttttagtaattgttttgaataaaacattacataaactaatggggcgaaactgtgttatcctttccggtttcagaactttagctatcaacaccacgattgcatcattcgtaccttctggaagtttcccggaagcgaagaagtccaacacaaaccgactaacagaatcacctactatatcccaacaatcctgataaaaaacaggttgaaagccgtcaggccctggagccttatacttccccatgcttcgaattgatgtctcaacctccaagggattaaacggcttgctcaaattagacatgaaaggccccgatccggactgcctaaagtccggacgagttctctcgacccaagccactaagtgactcggccctacccgtttatgaggttctttcctagtctaatccgtttcatatgattccgtgattcaatatatgagacgaatagagtaaacaaacaatcggatactttattgattaagcaaaggattcgatacaacctatgagtttgcatataagctattacaagtcatataatcgatccctagactatccgaactatcaccacccatcatcccggccttgagtctctcgcgcctaagccaagtccttcccacgatcaccattcgttcctgaaagtcatagagccataagtaatctcatttacttaatcatatgcaagtccatgcaatgctctatatgccatacactactcggatccgtggagagaatttagagaggggaagatcgcgcatcagtccggccgattctcggcaggtcagttaagacctgccggtcctccgccgagccgcgtccccacctcagccgatccctacccggaccgagtcttgtgtaggatgcacatgacccggatactacccagccctctagtcgatcctttcaaggatccgactactaactcacatcctagaacccttagactcaaagtctaggatcccttaccttccttctcgaggttaggtcgatccgaccctccttctttattgccggccacagcccggctaccgaatcctaagactatttattctcccaagagggagagagttttaatggtgagtttcttgtgttttgggtgtgttgtggtgagtggaatggtcctgggcgcccttccttatatagggggcgaatgaatgcttcccgaatcaacacatccgttccttgcacctttccgaagagttgcacctttccgaagagttgcgcccttccgaagagttgcacctttccgaagagttgtatctcttcgcccataaccgcccagctagtccgtcacttgtccagctacctcgagctcaaccgtcactcgtccagctacctcgagctcaaccgtcactcgtccagctgcccgagctggactgtcactcgacctgagtaaccgtcactccttccagctgagcttgagctttgggcgaactgacccagctgatttctttacgatcttagcttagcctgcatgatttcccctttgtccgagcttatggccagctccttctcacttgtccgagactccacctatttctctcagaccaagtcctagccaacgatcctattgaggatcgcgggcgttacaagtctccccccttgaattggattcgtcctcgaatccgcatcaagttgatctttacccatcttcttgaaccactccggaaaattggccttcatcttattctcggtttcccaagtgtattcttcacggcctccacaattctacaagacttttaacaaatcccttgattttccccgagtccctttcgacattcggtccatgatccgtaccggccatgcttccaccgtcatgttctcctttaacccgggaggtatatcttccacgctttcttcttgatcacttaaatacttccgtaattgtgacacatggaagacgttgtgaaacacatttagttttggaggaaggtcaagtttgtatgccaccgcccctactcgttcgatcaccttgtacgggccaacataccttgggcttaactttttccttgaggtgaatcgccctgcccctttgtaggtcatcgcctttaagtacaccaaatctcctacttggaattccaattcctttcgacgtttgttggcgtagcttttctgtcgatcttgggcttcctttaacttgatttttaagaacttcattctctccgtggtttcatccacgatcgtaggtccaaacaaccgacgttcgcccacgggcgtccaacacaacggtgttctacaagctcggccatacaacgcctcatagggagacataccaatactagcttgaaaactattattgtatgcaaactctattaaccttagatatttctcccagtttcctccccaatccaagacgcatgctctcaacatgtcctcaagggtttgaatcgttcgttcggactgtccgtccgtctgtgggtggtaggcagtacttaggttcactcgagttcctaaggccttttggaaagcattccaaaactttgacgtgaaccttgtgtctcggtctgacactatactaaccggaatcccatgtaaccgcatgatctcgtctatatacttctcggcaatgatttctgctccatccttatccgagatcgccatgaagtgcgcagacttagtcaatcggtctaccacaacccataccgcattgtgtttggatttgatccccgttggcagtcgagtgacgaagtccatcgttatgtggtcccacttccattccgatataggtaggttttgtaacaacccacttggtacttgatgctccgccttgaccagttgacaagtcgggcacttggccacccatctggccacgtctttcctcattcctacccaatggtagtaccttttaaggtcgcggtacatcttgttcgacccaggatggattgagaacttcgattgatgcgcctctcttaggatctcctcctttaatgccctatcgttcggcacacatactcgaccgttcaccacgattgtaccattgttcgaggtttggtactcggtcttgttgtttagtgtccatccttttatctcttcgtcccgttcctgagccagccggatcctactaagcaagtcggcctgatcagtggctcccaaccctaagggttcaacttctttagacaaggcattcacatgcaatgtccccatcatgttaaccaagtccacttggctccgttccgcctcaacttcctagcgcctcctactcagggcgtcggcgacttggttggccttgcccggatggtacgctatatccaagtcgtaatccgccacaagttccatccaccttcttagccttagattcaactccggctgggtgaatatgtactttaggcttttgtggtcagtatagatttaaactttagcaccatacaagtatgatcgccaaatcttcaaggcaaatactaccgcggccatttccaaatcatgcgtagggtaattcttctcatgtttccgcaattgccttgatgcgtatgcgataacactccccttttgcatcagtacgcatcctagtcccactatggatgcgtccgtataaaccgtatagggctcaccttcctccggtaagaccaataccggtgcattaatcaacatggcctttaactccaggaagcttttctcgcactcatccgaccagttgaatgcggtgtcttttccggtcagtcgagtcaagggttgggccatgctcgcaaaactcattacgaaccttcggtaataccccgctagtccgagaaaactcctaatctcggtggcattccttggtcgtggccactcctttatcgaccgtattttctccggatcaaccgatactccttggtccgagataacatgaccaagaaaaccaacgctcctttgccaaaatgagaatttacttaacttcgcaaatagctcatgttcccttagccgttccagcaccgcccttagatgttcttggtgagcttcccaagatttcgagtgaacaaggatatcgtcaatgaagatgataacaaactcgtctaagaaatcccggaataccccattcatcattttcatgaaggctgctggtgcattggtcaatccgaatggcatgaccacaaactcaaagtggccataccttgtccggaaagccgttttcctcacgtccgttggctctatgggaatttggtgatatcctgaggccaaatcgatttttgaaaaccactgtgcacctccaagttgatccatcaactcatctatccggggtaaaggatatttgtttttcaccgtaactttattcaatccccgatagtcgatgcatagcctaaagctaccatctttctttttcacaaacagaaccggcgcaccccatggtgagctactcggcctgatgaatcctttagccaacaactcctccaattgtttctttagctccgccatttccgccggtgccatccggtacggagctttagatatgggggttgtcccgggctcgagttctatcgtgaacgggtctgaccggtccggtggtacaccactaacggccgcaaacacgtccgagaactcgttgacgatcagaatgtctttcaactccgcactcgcccccacttccttggttgtgatcgtggctaaatatgcctcacaacctttcccgagcatcctttcagcctggattgccgagattaccaagcttcccgaggttgttcttattccttggaattttaacataccctcgtccctctcgaattgtatccgttctcgatgacaatctatgtgacccttgtacttccccaaccagtccatccctaagataacatcatgtttctttagtgggacaatgattaggtccgcgggcatattgacaccgttcactacaaccgagatgccccgaacaagtctggtcggatacattgcctgtcctccggccgctcgtaccattccataatcggtgtttggttctttcctgaacccacctgtttcaaccaattctagactaacaaaacaatgtgtagccccagaatcaaatagagtgtgcgttactacgtcacctactctcaaggtccctacacattcccttagaatgctgagtacctcccctttcccatatgcatgatgcaatgcaaatgcagttattgaaataatgaatagggagttgtgagaacgtaccagtgatcgccctgaagtttccggcatcgttagcttccttcgacaactcataaactcgcggtgccacggcttgccgctttgggggaggcggcagtccatttcccccgcgattgtccctttgtccggcctgcttctccgcagtcaacttagggcactctcgctttagatgtccagtctttccgcaatagaaacaagtccttgtctcttcaccgagaaccttggactgtcctggttccattcttgggcaactttggatcgcatggtccttgcttccacaccggccacatgcacctatggcctttcagcaagttccgctgtggctcttaccacaggtcacgcattccccggtcttagcatcggacttggtgttatccaccttgtcaaatttccttttcttatccgcgggtttggtgggtttgttggtaacctctcaacaacctcatcgacatcctccatagaataaagacgtgagtagtaatcgacagccatcttctcaagttcctgctgttgtgaaacccaactcccatcatccgctttgagcatttcaattctgtttctccgcctcctaacaacagtcatagtatggaaatactttgtgtttcggtctcccaactctacccacttctctcgggatttctgaaaccatagtacttcctcctgctcaaggaccacatcaaattccttaatcaactcctcctccttacttaagagattatcagtttggttaatttccaaaagctcttgaaccaccttaatttcattcatcaaactctccttccttctattcacgtctccaaagacttcacggttccacttttttaatttactctttagagctgccaatgctacaggcgtctctccttccgtattccaagaagcctgaagcaaatccttaaaaccactatgggtaagccaagccgcttcaaaccggaagggtctcctcagcggattactccgcacctctggttccagctgaatataaataggagcgtgatctgaagcgaagaacgggaggtgagtaactgaagcttcctgccactttaaacgtgtttgaggacggcatagcaccctatccaaacgctttgcgacaaaagtactttctacacgacctcgcttccatgtgaatttgttccctttgaatcccatatctatgagagagagctcatttatccattccccgaaagctagtgaatccggcgagagtcctccattccccccgttctttcgtcgagtctgataattgtgttaaaatcacctcctacaatgatcggctcatccacactctgcactatccggctcaacagactccatagtccacttcttctactaaccgaaggagccgcataaaccgccagcagatggatagccgctaacccattccccactttcgcgtgtatgaattgttccgctgactccacaattgaaacatctcccacctctgatttccacaagagccaaatacctccactctgccctcgcgcatctactctgaaagaattttcaaaacccaaattttgataaattctgaccgctttctcaccacccgcatgtgtctcaaacaaagccagaacatctattcgatgtttcttcagcatataccgaattgaacgacggaagttgggtttgttgaccccccggcaattccactttaagcaatccataagatatctgtaaatcaagggcaaacgaatcaccggggcgacctgttatacaagggcagagcttcccgcttcaggcgacaagcttccattcacacctatccctccctccactcgagtcccggctgaaatcaggctcgtcgtatccatttcattctcccggaccgataacagagcactctctgtgattttctccatctcagtcctggtcacaaaaattcctcctcgtctccccatggtacctttctctactcgaagccttttccctgtctcagaccgcactacctcacctttcgttgggccaaagacaagccctttagtgggcctattcgtgttctgcttggccttttgacgattctggtcattgggcttaaagaatccggcccgtctatccttcagcccacctttcagcccaattttccttatctcaagtcctccaccatcgattccctctcgaatcccttccttatcttgactaatactcttcccttgaataaacttacgcagagtattaacattttccttattctgaactcccgacaaatccgcctcacttccctccactggacttgattcgatatccaagttaccaaaactattcgataccagaatattccccgaattttttccttgagtgatttcccgaagattgcgccctacaacgcccgtagggccctctatcccattgaccaccgggacctgcggcggtgccgccttcttcctcgaccttctcaccaccgtaaaaccatcattctccggaactgctccactaaccaccaccggagcactctgagaagcggcattaacttctttctctgcaatagtctgtgggcaggtatggatcaagtgaccatacatgccacatcttgaacaaatattagccaaaccttcatacgagacaaaatatctctcaccattgagtaacaaagttcccttcaacggctttgccaaatctacttcaatacacattctagcaaagcgggctcgctctacatgcagcgttgtcatgtccactttcaccggctttcccaaagacccagctatacccataagaatggacgtgtgatacagagacaacgggatattcatcagacggacccaaattggtgttgttgtgatctcatcgcgtaaagggtcaaattctggagaccaggcttgcacgagaagataactgccaaacgctctccaaggaccacctgtgagtgccgacagatactcatcctctctttcaaatctgatcataaaaaactgacaaggcaggtccacgacgaacatagctccttgtggcttccacatctccctcaacctcctgttcaaattagcaatggagatattccgtcctaaaactttcaccaccatgcactgcttccacatactattcatcacatccaacacttccctaccaatcgttataaccgattcaccatctgctccattcgggaactctacacgcatcctcgaagaaacaaactcatcatccatcaaactctctgggcaaagcctccctcctgcattcgtacccatcactctcgccgcccaagatccccttccatccggcggatctcatggaggccgtacaccctctccgatctctgtcatagtagcatcgtgatcacccgtaaccctagccgtcatcgttacccaactcttctgttcaactatctgaatgtagtagtttagcatgatttgtttgtgctggttagataaattcaacataagatgaattaaattactttgttttccgtcaattgataaactaattcagtgatatttattgataaactaatgatttcttcggtttggtgatacaacattactatttatgatttttgtttatctaatgttataaagaaagccccagcccaaaaaaaacgtatcgtcccatttataaaaaaaaaatcaactggtgggagctaacgctcgcgtcttcttcctcttgacgtgattggaattcgtactcgcaggactattaaaaaatgaaatcccgcataaagataactacttttcactatctgtagatatgtgttttttttgcaatctttattctagcaatatatgagaaacaaagttaatgtttattgttttcattatttgagataatatggaaaaaaaaaatgaaaagaactgaatatcaattgtaaacattttattaattcgctgataaactgattccagtagctccctcaattccaatatgccctgtgttgtgaatagcttgaatctgttcacaaatgttaaaaaaatagattatctatattattaacatatcacgattataagaattttttgactgtgtttaccttgtagaaatgtctcttgcaatgcttagtcttacagattctgaaacacttctttgaacaccacgttcattgtttccttctgtgggttcccttctttgtccacaatgaggattttcaatcctttctttgaagtgacccttgagatagcaacgtagagttgtccatgcgaaaaacatggcctgggaagatagatgccaacgttctttaaagactgtccctggcttttattaatggtcattgcaaacgcaactgttattggaagttgtcttcgacgcattttaaaagggagtttactgtccgagagagatatcaatatcctgggaaggaggactttatgtccaactctatcacctgtaatgatgacagcctcaataattttatcacacatttgtgttatttgcaacctcgtgccattcattaagcctccttttggatctaggtttcttagcaacatcacaggacaaccgactttcaaccttataccatgatttggtaaaccagatacctttagactgttcaagaattctgatgttaacactggattattggtacctccaatgtcagaaggatctacagaatcagaacttaggtataattgttcctcacctacacataatatgacaataaaattaaccgcttatctagtacgaaagccttaaaaacatttaaccatgtttgaatactaaccttcgagttgatcaagcatataattgttgatcatacaaacgtcttcattggttggacataaaatcggtctctcttgaaagaaaaccggatcatttttttctttcaataacttaggatctccataaacttccctgcttattgcttcaattggattatcagcgtacttgattaaaaactcgtcgggtatgttaatcatcacttctccatcatttggtagtgctatcttaccatcaccaacaactaaaatccactctgaaaattcctttaaatccttcgcttcacttggactcaaatcatttgaaaacagccgcatatttttggtcagcttgagaactttgcaatgattccaaatataagaagcattaagagcagccatgcaaatctctgccctaccagcaccaggtataacaggtagtacctgcctgaaatcaccaccaaaaacaactacttttccaccaaaaggttttttcccaacacctcctataatatcagacaaactcctatccaaagattcaaaacaatgcctactcatcatgggagcttcatcccaaataatcaaagacgcttctttcaacaattcggcttgatttgagccacgctcaatattacatacagtgaaatcgtcaggattaattggaataccaaatcgagagtgcgctgtcctcccaccagctaacaatagagaagcaatcccacttgaagcaacgttaagcacaattgaacctctagatcttagtgaagctgaaagtgtcttatatataaaagtttttccagtcccaccaaaaccatagacaaagaatacacctccagtgtcattgtcaactgcctcaatgatctcagaatacacactcttttgctcatctgtcatcttctgcaacgattcttcaaatttatccctctgttcattccgattatagtttctttcgtcaagtatcaaaagattactatcatcatcatcttcttctggtaattgtggcattgtcttgaaagctgttagagatgttccattgcttcgtaagatactgttgatttcctttaaagcaaacatctgtttttgctcatcaaacaatattagttctgcagacgaatataacatgacatggcaacaatcaataatcaaaccaataaaatgtaaagatctatatagaacatatatctgtaaaatacaaaattatggtacctggtcagtcaaagtactctctcctttttctttctatatcttctgataggtgttcccaagttttttcccaaacaacttctggttgagaaaagcttgtagactggagcattacaacaaacaacaacgcaaatagtttccagttgcctagaaactggttcttattatgtcatcaatatactcctggtcatcatctagaaaacccaaagcaaaacatgtctgcttgaaggatttataaaccacaccattaactgtttttagatcatcaaaactctcaggtccagtttgtgtgttgagaaacactcttaaataataaccttcttcataaaaaggtggaacataatttatccttccaatcgtattccctggtcgctttctttgattgaaagtttttgctgtaccatcccaggtaaaatactctggaatctgagtatatgtgagatctttggctgtaggacaccgtttattcaattcaaaccaagccagaaacattgaattttgtagttctgaacgcttcaaaacgtgttgtacctcatcatcacctttaaaaaacagaagttgtttccctggtaggtgaaaggataacctctgaacggatgttgaccggtaatgtataggatttttcagaattctccaaccagcttcacatgctgatacatatctggttaaaaaaacacaaaacatgttagaaaaatatgtctaatctagatatagctactaagtaaaagatatgtttaatacctgcaatcaaagaaatcttgaatttcatcctgaattgtttttccactacttgagcttgtagacttctctttagaatttgtaatcttcgtaggctcatcatgaggctgaacaacaactgctacacgatccatccctttagtgatatacttgaataagtacttgatggatcctgtttagttacaccactcaacattaatatgagccctgtatcgaagcgacaactttttgttataaggaatgacatatccgttatcaaacttaaaaccacacttctccacaaagtgttttgtctttcgtcttctaaggcgatatcacctcattcgtgagattattggtagaggtgatgtgaagattagcagagtttcaacggatgcaaatgttgctggtcctattaccaaacctcttccgcagccgaagcatgagagtcatactgcttcgattggcattagatctataaagatgtgatattatttctagtgggagattttttcttttatgatatgatgttcatattaaaatacatttggatttaatttcaaattaatgaaattcgtttcagtattatttatttatttgataattaaataacagtcccaaaaaattgatatcattcttataggtcatcaagtacgtgacttgatcatgaaaccctgtaagtggaaaatgacatatattattgaagtccctagtcaaggttatgaaaatgggacattaataactgggaatgactagtatgtgaggtgactgatgactaagtttcatggagtcattaatatgtggtattaaagtcaatcacatatatatgtgttagagaacacaatattggattgacccgttatgaggactctacaagattgttatatgagtgtcataagagtttctcatcacaactatagagtatagtcctttgacctgagttcgtcatgatttcttactcatggattagttcgctttgactctttcaaacgtcagccataaaaggtgattatatagacagtgattgggcgcgttatgaattgtttaaggaacagggatggaacaagatggaatttgtccctcccatataacgggagataaatatctttgggcctatcgaagatttgatactgaaaaatgcgtggccgcgctcaaacaaggtgaatgtcagtcgtttgttttatcagtataaattggagttcgataaacatggtctagctgaataaggatgacaatttcttgccttatgctgagatcgagatatagagacaaagggattatgggaatagatgattccagtacaagtgggagattgttgggaatgtcctgaaatcagttgtactttattctagttaaagttgtaatgtcgaggtttgacatttgtataatattacgtggttataatattttgcaagagaccgcttataatctatgagtcagaactcattgctaatattatacaaacctacagggtcatacacttaagcaaattggatcaattaaaagagttattgggcttttgcccattattaaccctaattggttagggttaaacgtttggctgtatatatgatatattagcaacttttgtgagatacacttttgatcacaagaaccctaaaataaagagacaaagagttgtctaaagttttgagtttagatctcaaaggaactagcattccagatctgatctagtttgtgtgcgtgtggataccggtagaggcacaacacttggggtgctaaaataatctcgagataatatgattcacctttccccttcagaatatccaggtatattcaaacgccaagatctagatttgattatttatttacacagtttctggcaattgaattcgttgttacttgttagtatttataaattgttataaatcggtacgaattccttcagatgatgctttagagaaagaggataaacttcggtccgcttttaaccaggttcaagtgcttgagcatgagttaattatatgagaccaaaaaggtaatcctcccttccctttacctttaaatgaaagctttcaccctctccctcatctgcatccaaaccggagcgactttgttcaatcgcttttgcacttttttctctgcctggcaggcttttcatagttcacgacccctgttgagtagggtcggtataggtaaggcaatcgattcaaaagtagactgagagtggaggtttagaataacctaaggcgtactgtagaaggaaagaaaggtaagcaatcccagacccaatagggctacctttcttcgactgagacctatctgcttcattcccgagtttcacttcacttggacacagccaaagaaaaaggggggcttgatccaccgctttcaagtccagttaaattagagaactcctttttagaagaataggatagaatcttccgaatcagtcctactatggttggaccaaggtcatttcgactctctagactttcttgcttctttccatcctgagaagtagatcctttggaccttttctttcctgttgaacgagtggatgttttgaacgagtgttgagcgagtgaaatgccccataagctataagggcgagctatctctttagattctgtgagctgcgattgaactgaacgttccaagtgcatccagcaggaatcgaacctacttgcctctttattaggttgggcgctttaaccattcagccatggatgcaaagagagcgagtgaactaggttttggtattccttctcgagcttcaatttcttccgttataggagattcgagaaaagatggaataggaagacgtgtttccagaacaaacaagatacgggttgagaaggggaagttagcaaagttagacaagattggaatgggcataggaacatgtattgatgtaccagatcggctaatgctcccaggttgatgcgatgtattccaccagttgactgaagactttattattggtatatcgatcggtccagcacgaattgaaatagaagccggttcgacaggaagcttttgaaaacgcagtgcacccaggtaaataagaaacgagatgaatacagaggtcaaacgagcatcccacacccaaaaggtcccccacattggtcttccccgaaaccccccagtaactaaggtaaacaacgtaaaaaaagcacccatttctataccggttccggaagagcgaagataaaggggatgttttgttaataggaacaagaaagtgtttatagccgtggcgatataaacaataatactcatccgagccgcaggaacatgtacatagagaatacgagaatttccaccttgttgaagatctagtggtgctaccccaagacttaaatgaatagccatcgctgttaagaacaaccaagacccaatgagaatttgcgcgtagcttctggtctttgacatcaaaaaagaaggttgtaataacgaaacggacatgtgcaaattttgtcctagctagtggaacaagaaagacatggatctataatacgcaatcaaaggatttcccccaacgaataattccccctcccctgctttgtttgttttcgctctgcttgtgcgtggcactccttgctggcggagcggcgcatagcgaaaaaaagaaaaaaggaaactcaccaccaaaagatcagtccaataatcccactcactggtaaatagcgcaatacttcttcgtgaatctccgctatttgaatatggaacatcataacaacgaaaaggaatgaaacggctatagctcctatatgaactaccgggaagatcatagcgaagaagtcgagacctaacaaaagacgtaaacctgaaatggcggtttagtcgtcggaatcgcttttatttatgtcgtagtcagacagcaattccagtagctccacccaaaacttgtctccgttttttcctaaccgggaataaagatagtagaatcttttcttacgccgatcgatatcgatcatttcatgttcagtcatcacaacatttattgctcgttctatatcccgttcatccggaatatggtaaccttcggatactaagagttcatgtgtttttgctattatttttgccttgattttttcgcatttatcactctctgcttttacttgctccccgatggtatctgtgttttgatcctctacctcgaggttcaagaaaaggcgttttgagccactttccttgtactctttcgaccagaaaggtgaacccctctgctgatcgtgagagtgctcattctcatgagcataatatccttctaaaagaccaccctcagatggatttgtcgggggcattggcgtatttcctcctcctagtcctccggataccaccgggtagaactgagaaatggcacgacttaagtcgtccatccacaagtatcctacagcaaataaagatttacagagaataactgaaataacataaaaccaaatcagttgccattttttggaaagtttgtttataataggaagcgaacaaaaggaatctaaaaggacttttatgctgcaaaagactgggatgggaaacaaaacagaatgtacaaaacggataatacgtgtaaccagcaaaccaaagaccaaaacttcagtacggtccgtgcgccgtttttcttctctaccatgacgaatcaattgattaaacgtgggcattattctctttcctttctttttccccccattttgtgccctatcactttactcccgatccgaagcaccccttttccattcatatagaaatccaatcgtcaaaataaataaaaagagtccatcatggaccaaaatctgcccgagacaaagctgagctgtcaaataagaccaacaagggataagatagggaggctcctctaaagctggaacctcttccaaccccagcacggctcttccccgtcgactcctcgtacgcgtatcacaggggcaaacacgccttcaaaacatctggatcatacaaacttctcattcagtggaaaaaaccttaccaagactagttgcctcaacgaattgatatgcttttgctttttgtgacaccggcgcgaatgctgaatacggaggaatacaatgaaatcagaacaaagcaggtagaccaagctagcttacagaattcgaggaattcaaactcagaataagctcttttattagcacgtttggtagccagaaaggaaagaggttctcattcacagtgccttctccttctgtgatcactgatcaaaaggacattcattcagtaagggattgatcctcaaagtggttcttttagcacaatgaattacttatcttataatgaattacttatcttatatagtagtgtaaccttctcttcgtacaaaaaagcctattctgaaagccgtctttcaatgcctgtaccctagggcgagctaggttcaagggtacgcacctagtagctgcgagcctaagattaaaggcaagttcccttggttcggcacgctttcactcagtatgataggctacggtcagattcgctcggtctaggtatcaccttgatgcgcgtagttattgccttgatccctttcctttgctcgggtcattccattgcctaaaaaagtgagcctggatcttcggagaaaggattttagagctctgtggagaaagtcttgaaatattggatgctttctttcgtggttaggcgggcatggcatcaactctgtataggtgggttggcccggccggccaaagctagatatagatcggttggcactggatctgctggatagaggtagcggcacagacagctacggatggatagaattacgtcagcttgtcgggtcagtagatatgcccaggatccattttgactagaaatgaaatggtacagagaagcgcagtgagcggtagcaaccattgactactcgggccgggccttgcagccagaaaatgggactcgatcagctcagcccattgactcttttatggggaactattagagacctaggaaagtcaagatgccaccggggcgtagaaagaaaaaggcttcttcggcatgatagctctgctctgtcggataatatgagccccttatggaacagctcactccggggtgattctggtttagtcatagaatacagtaaatccatgcgtttgtcttcgccttttcggaagaccaagacagctagacgatagattaaccaaagccataaagagaagatcgatatcgcacagaaatcctggatctatcaaaaaagcccgccaaaggtgtcctcacatgaaatcatgaaaaggatccgagcccatcaaagactctactacatgaaaggatctgaatctatccaaatagctgtggcccatgatccaagggacccgcaaccagtcaatcatgctatccttaccttccaaccaatcggaaaaaattacgttcaattcaggatcgaatacatctttggcttatgagttatgcgttttctcttcttggcactttatgtctgctagtgcataatcatgcttatggaaatagtggaggttgagcagtttccctgatgaagagaactctccttctctaaacaagcttgcctgtgggcgtcgagtaagagcatctgggaattgatcttttacgagacagcccggagttggtctcgtggctaggtctttaaccgaaccggttcggaatagaaagtctcggtcaatgaagtggagtgggctgaaacagaaagttgggtattgtatttttatgctcgcttggccggaatcccctatagtgcttttcgggcgaagtgacggattactttttgagtgactaccctcagtctttcagagcctcgggataagctgttcttgtttcataagcaaatgtggcaacctggtggtatagtgagctctctctctggattaagcttcggtcattgatagagaggaatcacctagcctagcattagactcgactagctagccttccttgggcggattgctttgaatagcgtagttttcttagctccggggactgccttatctacactatgagaaatgttagatgcaaccattatagtatagatatattcttagatgattactatatgtgatttctttcatacagtcttaacaaatatagagatcttcaccataggagactagcttgaactaaatcctccaaccttaaagcagtatgagagaggacggataccagaaagaatcacctcggagccgctatgccactatgagaaacgttatactatagatagacatgagatgatattctataaggaatacaatgtttgaaaagcaagaatagatagagttgaaagaaaggcgctcgtatagagccctcgactatgtatcggacatatggcaggttgggaaagcgcgcttggaaaagaaagactatcctcgaggtaaatgtaaatcaatctatctcgcattgcccaatctgaatgctaaaggctcgtaaccccctaaaaggaaactcaccaccaaaagaaaaaggtaggttaactaacgaaactcaaaactacattttaattcttgctcaccgataatcctttataaaaaatattatacagctgtatacaggattattggtatagctgtccactagccgaaaatcggacaccaaattattgtagactgacgacctgtccttaatagaaccgatctgactctctgaacaatcggaatttcgtacttctgtcggatcctccctatctcctgatcgagcttgtgtaggtagatgttgcctggtagggccgatagtagtacactgtgtgggacggagtaagggcccctctcaactcctacgagtcgtccggcggaaaagactttctgaatggagtaaaagaacttgggatcgtcgatctcttccttcaaaatttggatgagtcgatgtcggtcgatggtgtgaaaacacttcctgatgtcgaattctaaaaaccagcgagagattccccactcttctttgatccgtcttaggaccgagtggcagccttgacccgagcggaaatgcgatgtgtctggaaactcgggatcgtaaatggattcgagtaccattctgatcgcctctttcatgatcttttctataggtagaactactgtgagcggtctaaacttcaacccttctttctttcttcatattgtaaaggggggaaaagctcgttttttgctccccttttttataatcaaaggccccctcctgccgtcgtttcagtgactcatagggcttccctcagttcagtctttttggttcttgaaaatggtcgccacctctcctcttctttcagtcgatggggttcctctccttttagtcgagtaatcaatacctctcccaggaccggaatgattatccctgcccgatgggtctacatccatccctgaatgtcgtcgggtactgttcacttccccgccattcttgtaaccgtcacctgtaatccgcgcgggtgtgtccgcacccccctgagtggacgagaaagaaaggatttctcggagcaaccccccaggttccagacccaggagtcaactttcccgtatgagcattcggtacatgtatcagtccgtgggaagaggtgaaagggtcaccactactgaggatctccccccccccctaatcttagataggtcgtctgagggttcgccgcggttcattgctgtgcttacacacaaggctacccttctccgaaagctacgcgggaccacctaccactagtcttcggccggaggggtttattgcacaaaaacggccgggacgcaggctcccgaagagggaagcccaacgaatgtcagatgcaaagttccgcacctcattaagatcatattggcatactctcccaaaaaaaaaagagcagaccccattgaagacgagagtaaggtacaacaaggccatttctgtccaccgcccttctcacggaaccgtacgtggacgttaccgctcatacagctcccagccagcaagcacagttagccttcctctacaagaaatggaaatgtggatgaatcgaatgaaatcgaggaattcggtttttcttttcagacatgataagtaagagcatccctttcacaaaaacctacggatccccctcctatcctgccacttcagcaccttgtgatctttgagaagatcattacgagccctttcctagaatgtttttgtagattccgaaaattccagagtggatcaggacgagaatgaatccgggaatccagggcatactcatcctggagcttccgctctcctctgggaagggcttttttatggatagagagatgagtcgagggattgattactcgactaaaaggagagggtagcctcccgtttgaccgatttctcggagtcggaagaagatctctcatctgatgaccctgaacaagaaggagctgctctcgatgtgagatcagcagcaaaagaaagaagaaaagggccatgatgatgatcctatgttcgttttcgccctgcccctatgatgcgctcctagctcgcagagcataagtcagcgcaaaggagagatacatcctttaagactgtgaagagaatccttggtttgacctacggactacgtgggaaatacgagatctaggcaagccgctacatgttctcccccttgcccttgaacgatagaagaactacttatcttctcttagatagcagtcgatcggttctatgatctatggtcaatcaataggcccacggatctattcttctatacgataaattgccatctcgtagcaccacagcctgggggtaagactagaagaggagatttgcttggtcttctgtgcggaatctgcttcctaatcagtgtagctcttgggtcagctcacagctaggacgtcatcagttctaaaggattcctcactagggagactctctccttatgggcaagggaggcagattttgatggggagaaggattcggaatatagttacataagtccccttccctctcctcaatatagtttcactcgagtcacgtcagtacctctccttttagtcgctcgtcgagacctcatcaactagttaatacctccggacctctcctttatcagtcgagtttgtgttcacaacctctcgagaaacaagttcgagagttacgtactttcaatgctctctctattccttgctaatcaaggcctgcaagggaactggctacgactataggcgggacgacatgcttttagcttccctgaaataggcgacttgctcgctttggcaggaagtattttttttgaagaattgaacaaaaaaaactgaaatttctgtaaatcattaaaacgggactttctttaaagaaaaatggtctctcaagacggtaccttccatcaagaaggtcctatccatcgtctggcaaagagacgcccaagatttatagcaagttttgacttgagcgctgccaccgatcggtggcccgttccagtcatatatgagcttatggcgtgccttttcggtcaaacgatggcatcgtgcattgtcaatggtgccttagcactcaactcatgctctttgaagtccgttactggacggcatgacgaagttgtgtttgttgcaggtcaacctttgggttattacggctcctgggctctattcgcgttgtcccaccatgctattgtgtggttggcagcattacgagcatatcctcatcagacgagaccatttctcgactacgctttgttaggtgatgacatcgtcattgccgatcgtagtgtggctaaggagtaccgttctctacttgatgctttgcaagtagatatatctgatgccaagtctattgtatctgagacgggttgtcttgagttcgccaagcggttctgggttaagataatgtcgaaggacttatccccagtatctgcgaaagctgtgcttgagagctacttcctcgttggtactcagcagttggcctataagtacaagttaagtcctaagacttgtttaaggttaaataaagctggataccgcgtgctaggacaaatggacactacactaaggccctatcccggcgttttagtcggattcaggcgttatctagtaagcttttagtcggtcctgatcggttaccactcgagtggtggattggaagaggattacctctcagtccctatcttcgtggtgtgttaattgcaaggattcgggatgggatgaagcttaagcagctcacgccccctcccttggagatgttcctttgtggagagccagaagcacatatcgcagaaaacaccgcttatagacattgtatgaacaatggtgtgagtacgtggtatggtttgacttcgttcctcgtcgtgccccttcccacctaggaagagatactaacccgcagctgcacttggtgcaatcacagcagaaaacccttctcctagacattcctcgggggcagaccacaccacctcggaaacaaacaaacagcacatgcagcaacagagacaggcgttcatcgctcacttacctgcatacatcatgacaacttgttcccatctcaccatgcagaggcgcgtagcgagtaacaatccggtccatgtgctggcttggcatggaaggcaaccctttctttttcgcagcgctacgcgcctccacattcagtgaagagatcccggacagggaagtcagaagggcagttactcttcggacctagcggccctgctttagctgcacttggtggttccccgctcgggattttatactggatttttcttttagggttagtgcaaggttggcttgtgcgaagtcgacaggggtggttgagaaacacgttttattgggatggggcagcaggcaatggataccgttcccccaccagagcctgcagttggtaggccaaatccctctgtccaagtgattgagttgaagcttttcagagaaagggtaatttctgagtgaatcaagagaagatgctctaaatgaccagaattaggcgccctatcgctactttgttatctaaggtcccacatcgatcacaaggtttttttttcaacgtctttgattatttactttcacttgcactactatgctatgctaccacggggaagttctaaatggcgaaagagaatcctttcagtccaggcactcagtgcagtccagacgctcaggagaagacggaggttaggaatgctgattggaaccaatacgattgcccagaggagctttataggtatccagagtcccgcacaaggagcagttgagacagatgcggaagaaggtgcggccgagacggttgatagagatgatccggcaggcggagagtttgattgcgacagtccagcctttcatacgagaaatggcggtgaccgtttgccctaaacaaatatctcaagatgtaacacatatgccttctcgtagagcactcccagaagctaccctgaagcctgatcgtgcttggaaaaggcatttcattgaccgaacccgacccatcccaccgagagtgcgaactgctctttattcgcttcatagctgggctttgcattggaacctctgattgagcccgcggagtcgccttactgcttgagtgagtaagccattcaagattgttgagcttggctcacttcagcttcagagctctggctattgcttgcttagaggaggaagcaggcgtgtggtgcttcccgcaatgaagtgtcttcccttagattcctctttatactcaagaagattagaaaaacactctgtggaactgcaagtggcgtattggagactgcacagcaagtggcgtagtggagtgagcgagcatcttatttgcccggatggaatagaggtttatcctattctctgtaaacagaaaaggaagttgtgctcaatgactggaataagctagtaccatagattattagctatggactactccttaagctagaggagacttgtttgtctgggataaattgtcattctagacccgattggaaagattgaattgaaagcaagaacatagacctgacgagaaagacccacattttgaatattaacttatgataatcaaagggagtcgtggttacgggtaaggttaggaagggcgggaaggacttccttactagaagaggatggtaagccatatgtgaagctgaggcaaagacattttatcttgaagatttagcggaaatcaaagtctaaagtgccttactgtgcgaaaacgcatattttactctctggccaagtctggagatagaccaggaaagacatcttcaaacctgcccgctgacactagtactgaagacttacttgaaagtggtactggctagtggactgatggagctggagaacggaatagacatccattagttcccgaagaaggcaggtttgagcaaggaggctcaagagtagcttttcctcttcctccctttcataacactccttccccgtcttactaggcgttaggtcctccattgcattctattctccggagcctaccaacttgcccacctcttaatctccgcccgttaacatataaaaaatcagactcttgtagattcgcctctttctttccgactcgcttcacgactcttttagtctcgttacgcttaataatcaaaataagcggaagccaactcttgaaaatctcaggtttacactgctagatcaaattcatactgaaatgcattaccctacctatctaaaaaaaagagggccctggggagcatgccaccctcaacccacaaactcccattctcctcagtctcccagtattggagacctacttactacatctcgaccgggggcctctccagtctttgcttaacaacttttctatagaaggattcaatccagccgcaggttcccctacggctaccttgttacgacttcaccccagtcgaagatcccagcacggtatgcctcagtcgacgtaatgccgggcattcacctgatggttccccaagcccctgagctcatcaatgaacggattccacctttcacagcgagctgttccgaagttgcgcctgagcacagtgaaatgcctcttacggtcatctatagcgtgctcccagtcgtcatgtagagccaactggagagcacgcttgacatcctctggatccccgagagttactccacgttgatgcaagagaatttgggctttccgtaccatggccgcctccaaattcgcgcaggcgctcgtgatagtctctacctcggcagagatgcggtcgtgctcttgtgcccgagcctccctttcccaagcctgctcctcaggaatcggttgattgaccgacgaggaggtacgcccggaactggccgaatcttcgaccatatcggatgtatacgtgaaccactcagacgaggccccgtcttggtgattcactatcccccccgatgaaccggtaactgaaaatgtgcccataaagacagtaaatacatccgcggagaatttaccaaaacccgccaagatatggctacgtagaagaacgagaaagagggagatttgacaaacaagggctagatagcaccattgtgtcatcctctttcctaaatactgctttaaggatctaaataggcaaattgaaaaaaccaatagaatcaagaagattataagattgaaacgggaaacgctttctgatcctagaaaacgtccgaaaaaacctgctacggaactactgagcatggacaaaaatacgataagtagatacataatttaatttcgagtgtgatcaaaaacctaaaatcagacaattacagagcggccagtgattgagtgatagatttctcgacgtccggagaacgctcgaccgaagaaatgagtaactaacaaggaagattttgttccccaacttgcttgattaacgggcattttcggggactagcccgcttcttcattaaaaaagagggcgattgcccggtccttggaatcattttagatcgtatccccaagcctgcctccactttcttatgtgaaagaggtgcttgctttatgagactgaatggaaaccttctttcttcgatcagaatacgaataagatcaaaaaggccatcattggggcaaacaatgcaatagcttcggttagagcaaagcccaaaatggcataaccaaatgattgtttagccaatgatggatttcgcgccacagaatgaatcaaagaactgaatacgtttccaataccgatagcagctcccgctgaagcaattgtagcagctccggcacctattgattttgcaccttctaacatctcgggttgagaattatactcacgctttgtcattcacttatcttatatcttattgattcctcgtcgattcttaccctcgttcctttgatcttggacatctcacttggaatgcattctttgcgatcttatacccacggagtggtagactgaagaccaactgaatctcgacaaagagaagtacaagcaagtagatcattcgacgtcagagggaatgactcgtagctagggtcccatctctcttcgattattcaatttgatccgtcttcgtcttctcttatgaaattgatagtttgtgagatcgattactcataaatgctgcccttctcttatatacgagagcaccagatacaccatggatggatacatacgatttcacttatcccaaaagtaaagatcttattcgtattctgatcgaggaaagaaggcgagctagttcaactcaatgacaacctctagggccaagcctatggaaagcttttccaatctccttccgcattctttcctttaatatgcttgtatcacataccaataagacataggaggatccgatagatttcaatcacataccaataagacataggagttcgttccgaacagataagatgttagttggctatcaatcttctttagcacgagtcgatccctattcttctatagttggtgagaactatgacttgaacctgctccttacttcaatcttcttttcaattcagatatggatggtaaagtccattcagatatagatggtaaaggaagatcaagttactcggctagaccattatccaaagaatggaaagctaaagcaagtcaaagaatcagtcccataattgaatggcatcgtcctttctttcccccatgaattgctttctctcgtactcatgcgatcccgtccgacccctttctacttgaactcctggttttgatgctgtgacttcccccatgaattgctttttcttcttttcttgctttcctgcgttgcgtacaactccttctcttattagagggctctcacggctcctatggttgaggagcgttgggcccattctaagttggagcgactctccggaagaattcctttgaagaaagatccaagcactcaacttgattggagaagttagcgaaagagtctcgagagcaaggcgttgagcggatcgacttttgctttcccctaataatctgaagggaacgggtgagaatgaagttcaggctaaccacagctcctttcgtttcagtgggggttgcagtctaatgagaaatgagggttgatcatcgatctgtagcgaatcttttctgccaattgactttcttgtccttcgccctctaagccattggttaagttggtgagtctaagtctaaagagtaggggcgtagcgaattgactattgtgatctctttagcttgaaataggcgctggagtctgtctgagtatgtaaaagatgtggtggataggataagaaagaaaccttctacatcagctaattcttcttccacgagggactcaaataaaggaggatcggtttctttcccgttcatcgtatcataggattgggggtctcttcctgtcctgaagaagcagctctttgcctttctgcttcaaagaaagagggggaatgagcagatcaagcctttcccttcatgcactagatggatcacttacaatgaccaatactcctcgtgagaatctaaggcgcttaaggaagcatctcgaatcgggcgtgaaaaagatccatctttgatttatttcacacaatttcgcaatgtcaacttgctcgatgtaggcttgctcccatattctccacggtttaaggcaagattggtgggaaagggatattctcgcatcgattacaatgaaatattctctgtagccgacatatgttccagttcgccaatagtatccatcgttcacagcttctgccccttttttggggggcacccagcagtttactgttaaggacactatcgacttactgtgatatgtctacagtcaaaagctagtactttatgggtagcatctttagggactcagagatcaggaaaacttgatagaaagccctagctctaacttgatagaatgccccagcaatggccatcggagaggtccaacgtaatttattactcttataaaagagggaactcgactgaaaggagagaagataaattccatttacaggctttctaccaatgaccggagaccagaaaggggaatagaagagataagccttgagcggtcagaccaattacgatcgattcgctaaacattcaagattctcgagatgaactgctaaaagaaggaagggcgatagagagaggtttttcactttcaactaagctaaggagattcgggatgggaacccgcactcttttgactgagaggcgtaggagatagggagttccccgtaatccgaaatatgatttagtacagaggccggccgaccccaaagtcctccaagtactcactcctttcaacgtcccaaggggcattaaagacatagagatcttggaaccaaggtgtcctcctatggaaggaataagaccttgaaacaagacccccaaaaaagggtctttatgggacctttgtcaaggtcgttcgctctgggctttgggttcaacgggtcgctttgaaaataaatagtctcatcacatctaaggtgcaaagattgacctcgatgcatgtcaaattttgaatgcctcatgacctatggttcggtcgtggaaaaccaccaaagggtggttggttgagatcttaaggaagaaataccgacccaaagatctggcatgtgtccttgagtcctcttctgccacgtgtcgcagggcagcaaacctataaaaagggatcgtatccgagaaagtactcctgctagcactgagtgtcttctttccactaggctgaaatacggctgatttctcacccgtgcgcacgcatctcgcttctggctccctgaccgatacgacctttctgggtttgttaacatccttccttctccttttgggtatttgctatcttgtggtccctgattcttaggctgaccacgtggtcctcttgcgacgtctgttgggaggtagcatccaaggtccgaaaggcctttattccgacccgacttgcggatccgggtttgggagaacctccttcgccgccggtgagttttctacatcagtctggttttgcttcggacaaagctctatccggtggccatattccccacactcaaaaacatataagatgcaagccttcgtattcgaccctctggatgtcatcattaagacaaaactgggaactctttttgaatttgaaatctacctccacacacacacgtgcatatagacccctagatgaatccactgtgcatagatcagcccggactgctttgaccagtttcttttcttcccaaaaaaatctggttcattaacaaattgaatcgtgatcactggggacgtctcctctcgtttgactcgagttgcctttaagtctcctaatcacatggatataggtgggttaattgttcttcctttcggatgagctaattgaatcagatgaagatatgagatcagttcagtctcattccgtaaagccaaagacgacattccattaaagatagagtgggtcgacctttcaaccaggacggttgggtgcgctaaagcaaaggcgtcttatcaagggcctgccgctcccctctttagttgtgacaagggagtgtgcttatgattctactttgttgctagaccaggtcttaaaacgcaattatgactaggtcgggactgacggggctcgaacccgcagcttccgccttgacagggcggtgctctgaccgattgaactacaatcccagttttaaaattattcttcttgtcaaccttcttctcatacgaaatttcaaaagaaagaagtagagtcgttggaccaacaaccgccaggataaaatctgtgtgagcggggcaaagacacctgtttgttttccgagcgagaaagagataaattggagattgtgtaatattacatccaatcttccttgagagctggaaaaattccatgaagaagagctcaaagtattcgttcccagtcggattctctaattaagatatagcagtcaaccatcaagaaatcatcaactatttcaccggggatgagctctatggctattctattaagtaaggatcaacttaggccttaggcttaagctagaactgctccttctatcacatcggattctagtaaagagatgggccttctcgtctgatctctgcatcaacaggaatgcgggaaaagcttcttctcgccccagagtccctagcagccttaagcccgctacgcccctttagttgaactggttgctatataggtcaattgaatcttagccagtttcttcttactccttttgttctcattcccggccaaccgtgccatgaagagtcgagcaagagcaatcgcagctttatctctgcctttgcagctcccattcctgccttataaaagcttcaatctacaaaagtagaactactgatgacaggtctggcctacaactgacttgctttcagacttactggctgaagagcaaagagatatctattttacagtaaattcctcttagaatagcatcccgctctttataggtttagtaatgctaccttgagcccaacgagtgtaatacctggagcgagtaatagagaggacagaagatatagactttttctttcctttctggcttgaccatgaggccatgactattcaaatcttacaggaagcaaccgctgtaccccgccttctagctcttagacttttagaagggggttcctccggcgccttgttccgttagtttacttttcattttaagtcttgtaagttagttatgtctttcaagggatatcaccatcccccgcacctcttattggtggaagcgcggggcgttgcaaccatcatccttggacccggaatatagagttcttccctggtacctggaggatggagaagagaaggcattgtctttccttgatggaaaactctatggtatagctatcattaacggaggaaattatccttccgcaccttgatctttctagggctattttcactaagccgaatctgtggactgagtggctaactattctaggagtggggcttttctttgtatcgagaaaatcttttgttaacagttcaaactccctggcaccatcccctgaataaggggctgggggaggtttgacaccctcccagatcacttgagcacaaagctttaaaaggagcaatagtggtcctgctaacgaggtactatgcccggttggtggactttccttaccaaagtggcaacacagaggtttggtcagaaagctgataagggtatgacaaccttacggattaggcaatacctaatcttactggttcttcgtcagagccgggcgccgtccatcacgtggcgtttgtccacgggtcaaggagagtagaaccggcggggtctttcttagtgttttgtggtacataccaaaaggtttgtcattttataccgattgatatggctttcaatttgtttaccacattcaccgagaggctccgcttggtctcttggcgcagtgtttttgaagacactcggtcactccggcgtttcctcattcggatcgccttagtggctactgggctcgttagtaaagaatcagcgattgtttgtcacgtcttagcaggcaaagtacttagaatgtacaagacatcgcgggacccttgtttgcgtattattgtaagtctgcctttacttagtatttatttccgacccgactccatcgctaagtcgaatagaaagcaaagaccttggaaagaaaagatctttcacccggattccaggaaaatgagctgccattatgaaccgctaccataccagaccagatttgacagacaagctccgttgcaagagtattccatctatccaaaatcccgcaaacgcttggagttggatccacaacaaaactcaaccgtggtcgtccagcacgataaattttgaacttacaccgaatcgcgaatcccgtgcaattgagattttctagttgaattcattcacaaaaccccgggaattttagatgaatcactccataacgaaaagtgctaaggtcctctcatttactatttgcgtaagttagttttttatataaaagagggcaaaactgtatgaaaaagttgctaaaactcgtcttttttcgttactttgaccgggatgtaaagatgtattttataaccttgtctgatgctgaccacatgcattaggcaactgttcagctattactcacgttagctgcatctcttccgagaccaggcccttttctcactcgtcgatggagaacctcaccctcaggctcaaaaatcgtcgttcttacgctttcgggggtctccctctctacagtgaggttctgtttgaagttatgattgagacaatgagtcacaggtctttcttttattcccttggaaatgaatcaccaagaaaaaggttattcattagcaacaaaaagagtaagacagccctgtcgggctcctgcagttagaagaagagcgcgaccggaaccaagcataaaagattgactgtgatgctacgtgcatacactgatcactacggagaagagaaaagatgtcataaagcatgggggggaccatcgacttcccccaaaaactattgattgggatcgatataacagagtgtgctcgataggaatcactattatgtccccgaatagaatgtatgtcacctttttctttccctttttgaccaacctgccgcgtatagtttagttgtttctttatgcgagggttgatgattctccagtttcggatgcctccggctgggaagaagccctaatcttcgagtcaggagataccttgagaacagtgaaagcggaatcctactttatttagtttaaaagaaggctttgtctcgtcccttcccattgtaattgtaggagggaaagtaaaaggagttattttaaaccaccctgcccctagccctaccatggaataaagatatagccctataacctggttttcagcagatctagaatctactgcccctctttcaacaaacttgcttgctatcccagcgcgtctatccttagttgtcgtgtctagcaagcgagaaaacgtaacgcgctaacgaacgcacttacgtagtaacccctacgcttgctgctggcgctaccttggatacgccaacccagcgagtaagggagtgagtctgtccaaagaagctcttaagaagcggagtttcactcgacaaaaaaggtttggactgaaaccattttcagacggaatcgactgacttctagttgcatcggatctagagatctgttgccagttccgatagaaggaaaggagtaaggtttaggctttacccaatagttgttgaactcgaggttggtaataaactgaagctgctcagtcttctagcatagcggagtgatatatatcgaagaatgaacttagccttcaaccacaaatggggtcctttaggcagccgattgcccgtttgcttccactgacttacgtcgtgaacatttctccaacccgtcaatgaaatgaagagaaaggcaacaggggaacaaggaaccagggaaagaccaacacaacttccttgacttcctaggcttagaaacccattcctataaacgggaaaagcttactaaccttacaactctggaagggattactttcttaccaactgacatggcttacctggcttaccttactaacaactaacaaacattcctgggattacttcctgacagggcttagcttacttactaaccttccttacacggaattacagggaagccaacacccgggatgttccgagtgaaagtagaagtttaaccggaactgtcgaaagattactacagaagaacccataagatgtcccttacatataccgatgtaaacaaagatctgaacgattgagagaaggaagatagagagtatgataggggaaaggatagcagtagagctcttatataccaaattcaaacggttatcctcctaggctagtaaacctagtcggaatgaagagtacgggagaaggaagacagattaggagagtgttcagtggatacaaagagaccaacagttcttcggaagcagaaggaaagaaagcaggagaaacacaaactgaccgagctagcgatgttcctattaggcttggagaactactcggaggatgaaagaaagagacagggaacaaagcacagtatacatcctactagagctgctaaccggtattcctcggtggttccgtcctttaagccagattattaagtaagatatggtttgacccttttcctttttgttttcattttcatctggaaaacacccggaaccagagcatgaaataacctttcttttttgtatgactgagaggaacgcctcaggtcgaatgaatacgaaagggagatcaatcaaagaaacaaaaaaggccatgaatgaagaagttgggcctttcaccctctttctagttactctgggagctgatctgataaatgcacttcaaagggagggaaggctaggtctttcccatcttggtatggccgagcataaaagatttgaaaatcaagtcaaaataagaaaaggtagagagaaaactgaacgaaagcggtagcccccgtcagggcaagagaaataaaaaataaggactcttgttttccgcatacgcatataggctgtgaaaaataagtctactttttttaatagagaaagtgagtgattcgtctactttcttaataaggtaacggaacgaacttcaagtccttcgtaggacgccgccgtttgctaagatgtgcttccacatcgtgagtctttagtgcacaagtcgtcgaatcccttaaaggaaaggtttggggcaggagtatcgacgacaagtcgtgcctgaagttgttcatgcacatcttgaggagctcttgctaagtaaacttatggggacaggcaaaagtaaaagctcgccaccttgcagtgaattccatgacaggttcattatacctttgcttggtttttagtagttcgggcactccaacccttctttgtgtgttgctgaactgcttcctgaactccgagacccttgcttcccaagtcgggatcgactcttcagagaggtggaggtacaaaggaaaaaacactggaaggagaggtagtttactggctagagagagtcagaaagcagtttagtaaggtagtttacaggctttcttcctttcttcaatgcttgagggacttctttaccgtctaacctagctagatctgagctaccttaatccgtttgtaagtaatggagtaagagttacctggattgagacagtctgaagctttcagcccttaggtccaattccagctgctgttgctctctcaggacttcctaggtaaatcgagtatgtgaaaaaaaattgtcaataaattctcacacatagtcaaacaccttatacaataggttatcagactacatcgatagttgcttgaagccaatagtgggtaagtgttagatgaacgaaccctcttgtggatcgctttctcttgcacgttaattaatcgataaattgcgtatgtaaggtctgctggtctgtcaaggagaatcaagattcgacgggacgctagcgccctaacaataacaagagggagtgctaagctagggttcaaatccaatagtagctagaaccagtgaaagggtagttcaccagacccgctcacgataatgcgaatgaaagggcagataagcctattactagttacgacgagaagatcctaacaggccggtttacaacagaaaaagaaaagataaggcttgaagacctattagtcgaggaattggcgttcctcggggatgaaaaggaattgatctgacccaatctattgatccggacgggactacgaaagattgactttcttccttcagcttgaaagcgggaaagaaaggaatagacagaagaaagtattagagaggaataagcgagtgtcagagtagtcctaacctcagttgaccgatgatggttctgctggttcttacttgaatctcttgctttgagaataatacttcaaaaaaatgcttttatcttgcgatgtcaccactcgctttatatatagtataggactagaccaactttcgccaatcttcgaccgctggcgtatatgaagcacgttttctccgtccctacctcccctgcacccggccatggatcaagacttctttctggttctcctccggcacaggaaagtaggttcgtggctctccgtctcctttcttgatgaagtaaggattcatttattttgtgtctagtcgagtacttggaagaaccccttggaatgcttttctattttcattcagcgctacgccccttgtgccaacccttttctcgtctaataaagaaaggagtcccgggccctacctctactgaatggacttctacagctaacgatccctgctaacagccggccttaccttaagttggaacgaacctatctcaacccatccatcttcattcgatcgatatgggatccttattccttatataatatatcagaatcttatctgtttaaccagctgataggcaactacactcccttttgtatgcatgctggtaagactgatagactgtcattctatcccttttcttgaaagagcgtatatgatggttatgaatggaaaaatgcaatgattgatcccacagcgctttatttagcatgctatacagtagtaaggttatatgaaaacagaccatgatatagacaaggggctagatcgtgataagggcattatagaaaaaatccctaattcaggcagtggcccgtcatgactttatctcaaaggatgtaataggagctaatggaagaaggataatgtgatcaatctccagtcctttacaccctcctgactatgccccttgtggtcaactgagtcgtgcagcacatcttttcgtatcttgacttggtactatctccttttctaattcatcctgtaagcaggtttgagcgctttgaccatctataaaaagcgaatcttcctactcctacacctctcctgtgctgtggggcttggctgcgtagaatatctatcttgttcatgtccctgcccgggatttcttccttggctgtagcttcgctccttgggtctactccccgtttttctggaaggttctacctagatgccggaggaacccattcccttcgttgatgttgtagctttcgttgtttagagggcgcatgaatggggcagctaattaattgcatagtagtgctgctgttcctgcaagcacgaagtccgcgctgtagcttctgtcatttcattagtattcctcttctcctccgttgggaataggttgcattaagggaacaggtatgtaggctttagccggcttctccctgtgcttacatggggtttattgcagctatcccctcgcatttgtagctcttgagcagccaagctctaatcaataggttctaaagtcgacttcgtctcgttattctgtgttaggtttgtaaacctaaggtgtacttcccgaggaacgccagttagtcgactaaagggagaggaacgcctatctacggtttaagcagtctaatctcactctctcgtccagaacaacttctttgggtttacttttctgtacatggaggggcggagcggttctgttaggttgttttattggattgcactgggcattcactgcgagctcttccgaggaaccccttgaacaaacaaaaaaaagggtaattagttctgttttaacagaccccttgttccatagctgctccctatctcgctaagctacctaacaaacagtctcgctctatctcgctaacttactgacgacctacctaacttttctctctcaataactctctcgtctagggcatccgcgcctgagaatgctgtaagctccctctcctctctagacaagtgcttgagtcatgacttcgccctctccttttcagtcgagttgctaaagcacctctcgccaagacgtcttttccagtgtcgatcatcttgctttcccgaattcgttagattgccaccagttccagaattgggagaacataggattggtagttgggctctgctcgcttggttggtcattcccttctgtcttggttgatggataggtgagcgcatgcggttacttccgaacgaaccggtcgatggcaagctttagcttagctggctagcggaacagaagatgggttaatgggctcttaaggcttgggattttatccactcgataggaaacgatcttcaaagaagacacctctcccgcttctgtgactcagcttcatcgtacaagggacttttagctcatcattccacttcgactggtaggggttttctattagtgcacttcggtgggaataagtcttcctcttttctttcggaaggagaaaaagatgcttcatttggttccctcggatcggtaaatccgaattcgtgacccaaactctatctagtttagttacatcaaaggtggctgccgaataaaaggggaaactttgcctgccagattgccttcggtaaccctaacccagttatcaaaagaaggcgccggttcggctttcaagagaggggagcgagctacacatagtgaagcgagtattcgatgaacacgaaggctttgatgaaaggaaaattgacatttcaagtaggtaaagtagggcgcttaggctggctgaaaacagataaaggagacatcatgtgcttggacgagttcctccgaggaatgccttagacggatgaatcccgctggtaaatacggcgggataggatccactcttgcagctgaacttctttgtctatttctctataacctcgtatatctttttactgcgcccgagaaagaaaagagcaagggtaagggccccgggagaagccactgactgctacttcctccgctacaactggtggttatggatggagaaaaagaggggagctttcgatttttaggaacttcttctagttagtagcgatgaattagaatgagaggatccatccaaattggggagaaagagacgtatccgacgaaagcaagatctatgataatagattcagtatggattctcttgtaggtaagttttagcttgagcttgatcaggatccaatctgtactatatattttgaaacatttgtgagatgccaaagagagttcgaacaaggttttgaatcaacaggatctaatctactgctacccctcgaaatggaattggtaggaatggaatgccgtgaacccaggattaggcctcgttagctcgcttactcttagtatagcaggtaaccaaccttcttccctttatggtctagctttgatttcactcagaaaagaagaaaatgataggaccttgattctgtcaaaaagtgagtcattttcctcctcaaaaccctataccccgtaagccatctagcccctttttccattacgtaagcagttcgaagtcttcaatgtattacattccttcatccggggaggttttcatagcctaaacagaatggaaatcataggtctctccgtatgtacctttagcgctcagttcggaagtagatttctttcgttccttcagttgcagcaaggacttatttagctctttctttagtctctatggcttggtgagttgtccaaagccaaggggccctacacttaacaagggagccactctgccagagcttcactctaggcctctcacgtcggtagctatccgtagatcactattggacgatcttcatctttctccgaattatactcttctttctatcttgttgcggggaagttcagtcatatagaaggtctaatcacgagcagttccaatcccagcctgcctaggcatcgaagaaaacatatccatatcccatgttatcgcactcgaaaccatgctagctcatgttgttggtatatcaccttcaaccgcagggccggaggcgcctactaactctgtctcgtcccaggctttcaacagcaggcatgtaaccttcaaaagaagcaattgaggatggaagcaatcgacccggactaatggacctctcccagcaacagcctttgatgatcttcctccgcaaagccgttattccactgcaagtcaagattttccttttgatcgtaatcgggattcgaccaagtcaactgcctttcctgaagcagatgaaacggcagatatttgaaacaaaactaaggaaagtaacattccgagtacaaagtttgactaatttgctcagttgcactgtgaaaaggtaccggaaggaagaatgaaagctaaacagcttggagttcccattccgaacggagagagatagattcaacagaggctttcctaggaaaaagagaggggatatattgaaaagagagcagaaatcccattacaagctgtaaaacagagcttacaacagttgtatcgcagtggacagagtaagcaacattcataagaagaagaaaagggtttttttcctaacaagccagcttgtgtcggcagttagcaacaaatgcatgacaaatccattcgcttggcaggagagacaggatgcaacaggtattccgtagagaaggtataaatctatactattattcaaacaaaacaaagaagttctctcttgactcttggtacctgcctcagctgcacctactcgaaagcaaaggaaacaagaaaagcaaggcagctacggaccaatacttcatacatccttcccggacgagacaagaaagggatcttacagacaggaagcaccacccggaacagcaacaactacaacgacgggtaactcgctggaaaaaagaagtcacaactagatcaagacctaaggagacttcgagcacacatcttccctatcacggctcatactaagaaagactctctagtaatgacagagcagctagccgctcaatcgtgccttacctcagtagatgcatacgcacaacccggaaggcactccttccctacaacttgtttacttaggaatcacagctacgccagcaatctatctcatcaagctacgtagaaccaggagaggagtgactcttaactgtgctctagcaacaagccagctagcccttatagtgcccgaagcgagatcggagtaggaagaccatgagcggaaaggcgttcctcgggactgacgtgactcttccacttgaccgatgaggtgaaggagtgagaactcttactataacagaagagaaaaaacaaacagttcccaaggaagaaacagtgaaacacagcaaacaacccgggaaggatctatacactaataggcctactggcgttcctcgaagtactccgggatatacaccagggcaactttgaaagacaagttagcaaccgtactactggtatgaattgagtattgcagactagtgctaagcccatagcaacaagactgctattatcagatagctaggacttattctacagctctttcacacaagggaacgtatggggatatctaaagagaaagtttatagttctgacttcctgccttaaaagcagattcaaagagacaagatccaattccttcagcctattcacagcggatgaagtaatagcattgtacaattagaacttcatacctttttcttgctttcttgttcttaagccagttacatactttattcgcccgaggggttcctccttttagtcgagtatgtaaacaacctgaaactaatgctttttccctttctagctttccaccattaagacttgttgacttcctacgctattcgattcgctggcatgtccggtctcatacgaaggaaaggctggatggtcagtcactcatgaattccttctcgaatcactactggaatatagcttatagaaagagcagcttgaagcaagtggcaatgctagaagggcatttctttcccgcctacttgagtagcgcgttggatctatgcttaggcagcttaatcgagacttcatatacgtagattgccatgtctgtatccgaacgaaaagaccttcctgatgttcttgccctatttaaaccccgggcaatttccaaaagaagagaaaacaaccacctcggaacaaatatcatgcatacataggaacccggcttcgctaacctttcttacttagtcgtgaaacaactgttcccatcgaacgtagagagatagtcaaatgacaaagaaaggaaatcagacctcggaacgcgctgcacagcacggaacagccattacatcagtgatcggcaaacaaagatagatacttaacagcagctacaagcaacaatagctacacccgcctagggaccactccagaagtaagctgcgattaaccagctcacttccctcattcgatagggaagacaacctgcagggatacatgcatgaacaggaatactgctacgcttacctacctgaccattcatgcaacaacttactcacataccaacaagggatatgaattctactgaagctgcaagcaacaggaactagtgccgcttagctacggtagttcgcaggccgttcttcactacctccatacatgcttcacacagaaacaactgctgtgcatacacagaaacaaggcagctatgcacactaactaaccattcctatcgatagaatacaagtaatggcagataggaaggatagtataaggtagggacagatagatagaataatacgtatataatcagaaggctgcttagaggagtgatctagctctctaacctctaactatcactaaactaaacaaagtggaattgaataagagaaagagattcgttggataagttgagaacaaagtggttcacaggtagctcagatggttagagcaaaggactgtaaatccttgtgttagtggttcgattccacaaccacttctatgcgttcctcggacgctaataacgaagcaaactacagaatctcaaatttatgaaaaatatggttcgactgttgttgcccctgctcggagctttggcaggtagtttttgcgcccgttttctaggatcagaaggaagcgctataatgaccactacgcgcgtttcattctcttcgatcttagtcgtaagcttcctattttgctttcattttcattcctttcgtttgaaagggccgcagaaaaagattatctatctctttttggtcttttccatggggttcgtgggatctttgatccggatcgaagtcatccacctagtggggggtctggctttgcccgtgttgggacctttggtcttgaatgcaataggggggcaagcacttccttctaccggcccttccgggtcgggcagttcttccatgtgggaggaagattcctttgaactgggagttctcgaggaatccgactcccccccggcaggggggtcccgaacggaagagggggaaccctcggtaaatcagggcagtcccctcccgtcccaaacggaagagggggaaccctcggtaaatcaagtgccccaggaagctgggcctgcgcttccagctaatccagtccctcccgggggggaggaagctgggccagtagtcccctatccatacaggagggatgaaatgattgggggggatagcgtagaggcgatagaacgccgccttctggcgaaataccccgaaggctctccctctgcggagatcatagagatggcccgaatagaggccgaagatctattcgagatcaaagcccaaatcatccaacggatggctctatatgacccaaccggcgattggatggcgcgtggggctcgggccctcgataatccgaggaccactagtggggaagagtccttggagcgtctttatgatatatggaaggacctccaagaaaccgggcccctctcggacgagttttctcgtttacaagagaaagtattcctcaagaaaggcggccctggggggggaccctatcgcataaggtctgcaagcctttcgggatgggcttttgcttctttctttatttttcgatatgccgcttcttcgccagcaaggagcgagaaaacaaagtgggctgtaatgatgtcagaatttgcaccaatttctatctatttagtgattagtctgctagtttctttgatcctactcggtgttccttttccatttgcttccaatagttctacctacccagaaaaattgtcggcctacgaatgtggtttcgatccttccggtgatgccagaagtcgtttcgatatacgattttatcttgtttcaattttatttttaatccctgatctggaagtaacctttttctttccttgggcagtacctcccaacaagattgatctgtttggattttggtccatgatggcctttttatttattttgacgattggatttctatatgaatggaaaaggggtgcttcggatcgggagtaaagtgatagggcacaaaatggggggaaaaagaaaggaaagagaataatgcccacgtttaatcaattgattcgtcatggtagagaagaaaaacggcgcacggaccgtactcgagctttggataaatgtccccagaaaacaggagtatgcccgcgtgtttcaacgagaacaccgaaaaaacctaattccgctccacgtaagatagccaaagtacggttgagcaatcgacatgatatatttgctcacatcccgggcgaaggtcataattcgcaggaacattctacggtgttaataagaggaggtagagtgaaagattcgccaggtgtaaaatcccattgtattcgaggagtaaaggatttgatgggaattccgggtcgaagaagaggcagatcaaaatatggtgcagaaaaacccaaatcgatatgaatggaagatgcctctggaactagtatcggtcagtcggtggaacaatcacaacgttacgccccaaaataaaactatatggagccgttacgaatgaccataatggagtctactacactagccaagaaagagtgcatttgactcacttcgcccgtggaggtggcagaggaagcctaaggcatgcccgggctagtgtaactgatctcgctactcaatccatatcgtcagttatatggttgcttcatccaagagagggtaagaaggttcgaaatcatcaatgagagcaggctatcgcttcctccttaccctctcatcgactgctggtagttggctgacttggttgatggctttatgtcatatgtgtgccaagttaggaaggttagaccgactaattgaaaggctttttcgttgagaatagtttgaagttcccttctttgtagcattgtaagttatttccttctttagcttatgaattttttttagggaaaagaatgagaaaagtgacagtggaaggagggaaagctccttattttacccgttctaaaagaagctcgattaagcaggaagatctttggtctcctgttctctagcttagtcagttagtggtatccgtcggtcggttagcagatttgcagatagaaaaggctagccagcctaagctgatcccgaggaaaggggctataggattgcccacgacaagcattggatttattttttgatgatctccgactcctaagtcttccgcgtgccttattccaccctcaaaaaacgattttcgtagtttatcagcccgtcttgcctcacacttctacttcaggagcttgccttgagggtacgatgacgatcttagtccgaataactgcttcagggtgggaatgaatagaaggccggtgctaaacgcccaatgctatttatacgaaaagactgatcgaaccaatgaagtaaggctttttaacactactttcaaaggtagaggcaaaaagcccactttttagcgacatgatagcatgaactcttcccccgatgtaaacatttcctgcctaacagatttgtagacgtccaggaagcttaagatcttaacaagaaagatataaggcgatggcgtcgccaattgcatgaaagaaaggccttttaggggagttggctcgtgtgtggagtgaattcctctgtcctgtgtgcggaaggcatatgaagtagtccagtaaggattcaagtcaggttgtatttggattttgcaactcggaaattatcatagattgatgatcctttccttaccctactgcctatcaacattaaaaatatgcaaaatagcccttatataaatataaccaacccgatctacgagtggatattgccttttttttcatcggcgatctttcatagagttgccgaagccagaaaatctgctaatgcaatccgcagaattacatcagatcaaggtgtggatctatttcgaacaagtgatatccaagaagaagccattcgttacttctccaacctgtttcagttttcaccggtgaaccacactcgagcctctatctcatcccttcgctctcttatcgacttcatcagatgctccaactagatgcaagcgaatcttctgcaacaggttaactacggaggagattccaaattgtcttttcagcatgccgctcgacaaatcccctggctcggatggttttccagctgacttttacagattaacttgggatattgttggcccggactttgttgttcaaactaaaagaaagaacgctaataaaataaaggtccgatctgatgtttacgatttgttgtggttaatcttcccaattgactaagtgcaagttagaacatggtagcttctgattcacggccaatgagactccgcttgcgagctgaactctttttggcatcattcgcagtgagagaagagagcatacgcagtgaagaagggagtggagcttatatttcaaagtatattaaaggtattctaaaatcaagattatcccgacgtgagcagtcacgctggaatataatagatgatacaacttctatggctttctttgaagaatttgcgtctcttaatccagtttttcatactttcttattttacgggaggagagacggagaagatctttcttttcacattgttgggttttttcgtctatcgatacggggttacatattctttttatgggaaagcttttagctaccgaaaaggatccgagcaagctcatcttctagaatcaaatcacatcgaagaaaggtagcactggaagggcagagtactcaatttttttatctttgtgcaagtaatgatcgtgtcagcatcttttggttaactgattcagttaccgatcaatctggccctaggttccctagctccaacgcggaaggactctcatttcgtccagatctttgctttgcggcatctccaactgtaagctctgatggaccaacacttatgcatgcgatttcaagtcttcataaatgaaaaagttcgagtcattacacaagcaaaggatagctataacgagaaaaaggtattttattttgctaatcccaaggggaatgtgaaatgtggaatgaatcaggaaatagccctttgatttatcaaaaatacagaagtagtagtcttcccgggtctcactgttcggataactttccttttaatcctactgcataggcaagatctcatccttcggcgaatcatgtggggctcagaagagtgctccctacgacggtaaatcggggcaaaagaccctttcttcgacgacgtggacacggggagggagcaggcgaagcgtgtcgttcgtaatggaaagaaagagaccactagttcgcctctttgttggaccgccggcgcgaacacagtggtctctgatcaggaccaggaaccaattcgaatttggatcttgacatgttggtggtttttaaccgtaggcatcttgccaggaagttggtgggcttatcatgaattaggtcggggtggctggtggtttcgggatcccgtagaaaatgcttcttttatgcctcgggtattagccacagctcgtattcattctgtaattttaccccttcttcattcttggacctcgtttcttaatattgtgacttttccatgctgtgtctcaggaaccttttcaatacggtccggattgctagctcccgttcatagttttgctacagatgatacacgaggaatctttttatggtggttcttccttctaatgaccggcatatctatgattcttttctaccagatgaagcagcaggcatcggtccgtagaacgtataaaaaagagatggttgtggcgcgaagtactcttgtgcatctacgtcactcggctcgcgcgcaaccccgccccgttatgttatggaagaattgaacttcttgctgggctggttattcagagccagcaattggctgccggatttcgtcctgcaatgaggcagatcgcttcggggggtcactgtggcgtggctgaatgtagagcagtccgcccctacagcgtttgatcagtagattatttagaacttcggaagatggtcaaggtacgaagtgacaagccactgcgctagatgcgcatgtggtcgtagtagtcggctcgtcgctacttttatccaaagaataaggcctacaagctctctgtttggagacagaacaacgttataagttctgagtcgtatgaaaactagcggtttgggggaaatagcgatttatcaataacatagaataaacaagcttgcttggcagactggaagataaaggcaagcagcaacatagagtaccttgacctgctcgctggggacataaggattgacatgtgccgagacagctgtcccgcggattaaggaatccgcaaaggctaatgccataagacgagcaagactaaagaaagagaagatcggtcctcgtccactcggaaagctttttctcatcatagggggacggagacggttagtcagcattccactaccaacgagcagcaaactccttgcgactctaattgagaaaaacccaacaacggccaccctccctaggtgtaagataatagggcttgatgcctagcggcttccttttacgggttgtccgatctcaaaggtttacaccttttaggaatgaatgttccacgagtcgttatgctttgattgtcgtctttcgaatgaaggatttgtctagctaataaacatcatccttcagtccgcgccggcattccagaacgaattcttatcgcttagcacaagcgctaaccctgacaaggccctacatcgcatatgcagttggagtggttagtcgattcatgcaaaatccaaagaaacctcactttcgacgaatattgaggtacatgaaaggaagacttgactatggtcttctgtataagaaaggagaacagtgtaagatagttggctattgtgacgccgactatgctggtgatcacgacacgcgtcgatcaacaactggaaacgtgttcaggcttggtttaggagcagtttgtctttgaaaagtaagcggtgttttagccgtaacccttgttggaagagaataccacgtaggagtgaaaactcccctgctcatctatcttcattccaaaggcgaacatttcaattgagtgactgtaactgctatctatagtttacagtcagtagttcttaaccaaccgcccagctttataaagctttaagagggaatagggagtaagggggaccttcgcttcattatcaaattgacctggaccctctttcttctcctgctgcagattttgccctgcgcggattctggagcttcttctttagtctaggatttcaaataataatcaaatcaaaagaagcggctgggcgagaacaagaagcggtcgtcgtacgccggccggtagctctactaagcgaagaaccgctcgctgccttttcttcgcgaataaccatgtggagtggaggtagcctaggagaagagaagcaagctacccttcgcctacctcccatctataagcggcaatggtaagagctggtaagcatggtaactgtatcggctaaggggtcggcgctccgcgttctatctaggttccgctctgacctttccccacctcacatagaagaaggggaagcccttcaatagaagaacccgtgtgagtgggaggattgaatcattcattcatcggatacgtcttttcccgtgatccatttcatgtcaactctaattagttatcaaaaggcctaccttacaaagggaaacggccgcatcggcccgcttcgtcaccgtcggttcccgcaaccaagcctttctcttattctttctttcagaagggcttgcggttcattacaccaaaggctttcagtgaactattgaagctatcgagagagtaccaaatgctgacggtgacgaaggttaccgactttcggtggacgcggagccaacgagttcagtcgaagagcgtaacgagtctaaggttacagaagcgttcgccaactttgataggtatagcattgcgagcaaatagagagcagagagcttaccctttctttctatgagagtcgcgagcttgttgtagtcggtcctaaagaaccttgctgcttacttgctatattcccgcgttcttgcacggcttgcgcgtaaccccgccctgcttctcccttccccctcccccccttaccgtccaaaactcagaggccgtatggagtatagccaagtggtaaggcaccggtttttggtaccggcatgcaaaggttcgaatccttttactccagattatgaacacccgatcggatctgtcaagaacgagctgacgacggaagctctcattaattagttgatgaggggaagcgactgacagcagtccctgagctaagccttggaaatcttaatgccataatgcctttaaaatcctcctagccattatcctactgcaataattcttgctaagaagaacgcccatgttgtggcaattccacccattaatagtaatggaactctgtgcaaagtttcctccagtaatatgagttaccaccccttgatcacttatactacccctcacactgatcgtacttccggcaaacataactagttcttcgagtaagattgggttgaagcggaaggatattcgctttattagctaaggctgattgaattgctaactgaacttaactagtctaattccattattctgaccctgcaggctttgatcttttttattctcatcgaaatcggaagatttgaaagcggaaagaagattctagccttccttccatattaaaagatcaaggaagacgagcaagaaaacggatgcgcgttagcgcaacggctttcgctaacgttgttcaatccgttgcttgttcccttgacctttcattcacactctgattgacgctacccggtccactcaaagcttgaaggatgaagaggccgacctctgtttttgaacaagttggtcaaggttcgttatcttaagcattcctgttggaacgactagctggaaaggcactaacgctttgccgagttatgatagggggatgaggagaacagacagagatggtcatacagacttctttatcagaccgactgctgatcgccttcaaacgactcttccagtcgctgacctacctcgaggagtgactctttatatggtgtttagctgagggaaagaaggtgttatggcctgcccgagaaggagattaaggctctttttatggcagtggagaagtggatgaggatgaagtgttctcactatggtgattcggtgaagagggcgttaagcctagtgaattcttgttgagatttggtagaccttgcgaatgtagctacttctgactatgttccccctcctaatccttctaccactactgagcataaaactctatctgtatgtgaggatgagtacactaaattccttcagtatcaagcagcaagtaatctgttcctactgcatcgccctacctttctagggccttgagttgggatacggttctagttccaaacccctctattcattcgtttgtagccgtgggtcacattcattcctgctgtttgtcggtagtcttctcggtttatcctatgtaataagaggtaaaagtagtaggagcgagaccgttgtagctagagcagtcaatccctttatcgataaagtggtaatgaagggtctgtagtaagcaaacccagtagctgctcttagtaagaccagtcacagggatatataaaaccagagaaaggctgacttctatttcaactgaaacaggcttggctggaagatcttttattaagtcagactggctagaagcgctatagactgaccgttagaagtcattgatagggatgttgaacactatcaattacttctctttagtaccggtataacatcgactactaaaagtagaagggaagaaaggttatccagccacttcttttggtccgggataggaggcttgttgaatcagacgaaataggacatcggtgccggtactcgattcgaagcatggctggacgccgcactcctggcacctaaaggtgcttttttcgcgtactctttttttgtgatttcccggtagggagggatgtttttagtacagatcttttaagcgaaccactagaaggagtctttgattgaggatcatctgagatggatgagccatctcctttccattgccagtcaagcctgccattcaacaagccctgttgtggtcatcagactttattataaaataagtaacggaaaataatccattgctccgttgactctttcaagcaagggcttccttgtctcagaggccccttcaaccggcttcaaaactcgctattctgctgacgattttagcctttatatatcaccccgaatggagtactcaagttgaaccgggcggacctttggaagggtctgttcgagaacttcacaacttcactctagggccaacctcgaagggtttcctctctttatgaaatagaacagcagccaaccaccgaggttcctcactagatatataggactggtaccttcggtctcttgcgacactccgagcaatgttgccgctctgttcgcttctttttcaatgacggtaacagaccaaccttcaatggcagataattatcaatttgacttaggaggttccgatgcaaaggccacacctgtggttgattgcctccgccacctctctacagtcagtttaaaattccactctcacctgttggtgcttaaactttcagcagcccaaaaaacactcaaaagctccgcttcgaaagcagttgttgttggcataaaggctcttcgtcaagtcgaaccacaccgaggaggcacttgttaaccaccggatggagcaagttcgtgaacaataagaagctaatcgctggtgattctgttgtatttatgaggaaatcggctgatgagatgtttattggtgtaaggcgagcaccaatctctagtaacgtcggaggaacaagcttctacggcggagatgagtactgtagttattatcagagcaatggaggcgttgctaaggaagacgacggaagtgcgaagaaggggtttaggaggactgggaaagggaaattgacggctgaagctgtctctgaggcgattaatagagcagctcagggtttgccgtttgaggtggtttattatcctacggctggatggtcggactttgtggtgaaggcagaagatgttgaggcttccatggctatattctggactcctggtactagagtgaagatggccatggagactaaggactcttcgcggattacttggtttcaggggattgtcttctatacatatcaggaaactggtccatggcgtggatctccttggaaacagcttcaggtataagatccccttcactattcccttaatattcctctgatgttgagctgatgggaaaatatataaatctggttattcgaatgctaatttgggtttggaatgtgaggttccagttgtgtcaagtttggattgctgtgttggggggattcgtggtttgaaatcgaaatatgttgattggaagcagtattagttagttcattttcaaatgaatgccatatcccttagttttgttgtttgagattcatcttcaacaaagatacattggaaaaagaagtcggaagatcttggtcttagtattgtttgtgttgcactcagatacagtaaatcgctacaatctctcttctctcttctcctatccctccgcttgcttccgttttcaatctctcctttctctcagacattacggtctctttctctctctctctttctgagcggtgatcatgctctgtacattctagtatatgttgatgatcttagaatcacatggtccaatcctcttcatattgatgacatagtatgcatcaaaaatgccatcttttctataaagtatctggctcaatcttggtcaaaaagtgagtagaacttctgcttctatctttctcaaaacattactgatctattggtcaaggctggcatggaaataacctctcccttctcccatagtcacttctgggtcctctttgtctgctctgctgttgtaagttccactttgctgctaatcctcatctctatcgtagctagagcattcttggtggttgctagcataaccagacctgacatagcttactcagtgaactttcacaatttctgatgagaccttagatagaaaagaaggtttagattaaagtttctattccttcctattaaacgctttcaaaagattgttgagatatcttctctgaattgtctgcacttgacaccttcctctcaacttgctcttgttttagtgatgctgattggccttcgtgggaatttatagatcactctcaggatattggctttttcttgggagatcctacgggaaaagaaggaaagaagtcaaaataagagagtaagagcctaggttagaagtcagtttcagttctcttaggtctctttccacatatacaaactgagagttcagtctcatatagcatgaggggacatggcttggtaatcgattcaaattggacatagataatctttcaatttctcatattatatatgataatataggcgtggaaaatttattggggttataaaaaaaaaaagaatcctcgtctttacagtcttatcaattgtgataagaaagcgctcttagttcagttcggtagaacgtgggtctccaaaacccaatgtcgtaggttcaaatcctacagagcgtgattccgttgctcttgttaggtcgaaaattagactgaactcaaataattgaacagtaatctgaatttgatctctcgccagaattgatttaaccaatagacatatatattatctttcttacttctgaccagtggtgctctatacatattggtgaatttagatatgaaaatgaaatctcctttatttagaggaccactggtcaacagttccacagaaaatccaattcatatcctaacgcgagagaaattgagacatcagaccagtggtacaaactcaacagagaaagtaatactacctaatatacttcatagttatatcaaaaacctaaacttagatttcacatcaccatatggatcaactggtaataatgaagtattaagcatacttcgtagtaggtttaaacaaagcattttcccatcatctggattaaagtgtttggatactactggtgattttctcatcaaaaatgttttacataaaagatatgaaagtgttcagaagaatatctcaaatgcattatcatcctccataaattctcgcactgcagtcttcttttgtatactgttcagtataacagtgttaatggaaatagctcctggacctcttttgaagaaaccttcattattattttcagataatttaccaaatgtattgcaatatacacgagatgtgtatgtgaatcatgtttgtataatacacaaaagtttaagtccatgtgagtgcgaggagcctctcaatcaaattattagagatatgtttccgcaaaccacttttgacccacttgaactacagaaaccttcacccagtaaagtgaaaactataacctacatgcttggtactattcttcttgtaattacattaatggataagactggatacactcaattagttaaaatgtagatagaatgaaatacacattaacctccttctccatttactgttctttgattctaacctccttctccatttcccgttctgtcctagttctttgtttctaacattcttagcttaccgagataagcaattccctacctagaaaaagatgatcaaaggcattgaggatcaagctatccttcttttgctgttgaattgaattgaattatgttttggtaaggacatcagtattgatcctcgtctgatatagagactttcaggttttctagatcagctattatcctttgaaactcattaacgtcctcaaactaaggaaagaagtgctcagtgagctttaaatgattgaattggactttcggtcagaagtgagcctaagctttgttgtgagctgtctcgtttccctgtactcgcattcgcttacatcaaaccaatcaagctaggattcttgtgggattgactcctggtaaggaaccgtctttacatctctaacttgttggctcgttaggaagggaagttaaagcttgcctgtaaggggaaggcaagctctctaagcaagctgttttcatgcctatactagctttctttgtttgacaggttgggggaatacccaattcaaagagatcaagcttacactgcacagatttgaccttattaagaaagtttccgggaaggggtagaagatgctagatgtttccctagggtcttgactagttcctacttccttgcttccagtgtagaaggtgtagctggcatactggagtcaatatcttagttcagttgttgcctccggttgtcatactggaatgagtcaatatcttagtatcgtctgtaatgtggaagaagtagctagatgtcttccctgtggttctctgctagtggatacttctctctagcggtgtatcgggtgttggcacttcggttgttgccagtcctgtcatttcctagaatatgtgttagtataggctggaatatgtaagtattgtctagaagttccctgttggtcccttactagtctgctcttctttgttccagtgagttctgtcatgaagtgtagctcatgttaggattacccgggaagcgagcttgtcgacgacgacgggtaagccgtgtgagcggttaagggttgcttgttgctcagctgtctttagtcaatatcttatgaatgttccggtccagggaataatgtgaatgtagctagagtgttcctaaggtgcgtgcatactagggcttcttcctctagttaccgttgtagctgaaccagcacttgcagctgtatattctgggcgaggagcgtaagcgacatggcatatttgtgaaagaatctcccttctcttcgttcggactagccatgaataaccagttggttgcttccagtggaggaacccctgttcatgcatggcggggcccgggatcccttgctgctgcggtaaaagagtcttccttcttctgggcggaatgtgtatgagtaggcgtgaagtaggcgaagcagtcctcccgttgatacgtgggataggagaaggggtctaccactttatatcactaagttccccctctccgtcttgcaggtattgtttctgggttgtgtctgcttcccgctgtgcagcttccacttcctttctttgttctctgggaataagtagcatgaagagttcatctgttgtccgtaggtccctggctgagttatcatgtgtagctaagtacgatctgcgttctgctgtcagttaataatctcctcctctctttgttcggatgggaactattgtatctgttgttaacccttgtatctggctacgccgcccttagaagcagagtagccagtccagtaggtgtagttagttatctgttcaagtaggtaggaggaacccagcttctcctatctcataggaggaacccgtagaatcaatatcttttctttctttccacagaaggtcagcggtcatactcttcgtactgttgttagctgttcctgttccagacgaagtaaggtagccggctcagtctcttactcggagaggaacgcctactactcgactaataggagaggaacgcctactactcgactaataggagaggaacgcctttgacttctttctctttcgaaaaaaaggaatgtagttagcctaatcactgggatgatgattggatcagtttagctactctgttaaggtctacatcaggaggttcaactaagcccgcaggtatatttggcaggcacctgaagcgagttgactctagctaggaagttcttctctggcctgtcacctgagttagaggctaggctccgaagccttcagttctttagtctccctgagagttgttagagaaggcagcattggtcgagagagtgtgagcgaagcgtagtagcgctgctataccgagaaaagtaatcaaacctaaatctaggaaatacagctgggtgtgctcatgttggctaggtagcagggccagacaatccctttactttcactttcgtgtgtgcgtactattaagagttacgtgtgtgcgtactattaagagttaggagtataccagcacagagagaggagtgtgcttcaggtagagcacagaggaggataacagttaggagagttaggaaggagtaacccagcactgtgctagagaaagcagaggagtaccgagaaaaagcagcagtgtgctgtacagagaacagaggaaaaaaaagttcgcagcaaaagataaaacagagacggaaccttccccccttcatgctgtacaaaagcggccagcacaaggtcaaggcgaagacggagcagcactacctggagatgatcctggcgaagaacgaaccattaccattctaaggagggggaagcactactatatatctctttcttaagaagctatttctaagttccactttccattaaccgaagtctaatgatcgcctggcattagcgccatcctaccgtctcgtttatgagcttgcatcttgtacttctcctgcctctgaaggaccggaccaatgatagaccatgggaaacaggaaattgaccaatgatagttactcggaaactgggaataggttcggggtctagctatttaccatagtaagctatccttaagggcttcgatcggtccatatcaagaaagtcattccgcttacggctagcgagcactttcttttggtgaatatccggcgaatgaaataaccattgtaaaagctagagatgaatgcccagcactctcggactgatcatcttgctgcaagaaagcttcaggtcattgctggttcgtatgatccagcttccagtacaaaggcaatgtactaagaaagccaaacttggacaggggcccttacgtatctaagacatagttcgtggcatacgatcgaagaaagctgggcggaaagctcggacaccaacctcaaaaggcggtgttgaccctgttacagtacagggaagatccgtttagccaaaacgagaagatcttccatagtctagttagggggtggatttttttcattcctcaatgggtgctgcttttgactgctatctcgtatcgatctagtattgcggcttacgctagattgacacctttccttgaatacgaataaacgtgagagccaaccccataggtatgacccaggagggccaaaagtggcatttcttgcttcttaaaaagctgattgtgaagagggtctgccctttgaatctcctcgagccgggtctagtcagtctttttccctcgccctggggaatcgtagctctgtctctgcctattatgctggtacctaagaaggaatggggcgaccgaccccatgttactaatcgaaaacgttcgtttcgagacccccatgtgtcctttgatgctgactgagctaccgaagcgatgttcgttaggattgcaagacacgtcgttttagtcgggcaatatccgatgtcggaagaacaagaactgaataggctcgcagacctggtaccttaaagtcttcaccgtttgagaacacccgaatccgagtggcttagcaagagactctaagacagatcatccgcgccggaatcccctaacttcatttttggtattcccttttcgggttctagagtcgacaagcccataagacgataccgatgcccagagaccgaacacagacttatctttcccatatggctctataagacatccatggaatctttccacccccaacatctctattctttctattccgaatggcgcccagtatttttaagtatggttgtatacttttcctgcctggaactcctgaattaattctttttctataggaaggaactcaagcaatccggcatccccggcagctatgcaattacttaattcagtctacaataatttggtgtccgattttcggctagtggacagctataccaataatcctgtatacagctgtataatattttttataaaggattatcggtgagcaagaattaaaatgtagttttgagtttcgttagttaacctacctttttcttttggtggtgagtttccttttagggggttacgagcctttagcattcagattgggcaatgcgagatagattgatttacatttacctcgaggatagtctttcttttccaagcgcgctttcccaacctgccatatgtccgatacatagtcgagggctctatacgagcgcctttctttcaactctatctattcttgcttttcaaacattgtattccttatagaatatcatctcatgtctatctatagtataacgtttctcatagtggcatagcggctccgaggtgattctttctggtatccgtcctctctcatactgctttaaggttggaggatttagttcaagctagtctcctatggtgaagatctctatatttgttaagactgtatgaaagaaatcacatatagtaatcatctaagaatatatctatactataatggttgcatctaacatttctcatagtgtagataaggcagtccccggagctaagaaaactacgctattcaaagcaatccgcccaaggaaggctagctagtcgagtctaatgctaggctaggtgattcctctctatcaatgaccgaagcttaatccagagagagagctcactataccaccaggttgccacatttgcttatgaaacaagaacagcttatcccgaggctctgaaagactgagggtagtcactcaaaaagtaatccgtcacttcgcccgaaaagcactataggggattccggccaagcgagcataaaaatacaatacccaactttctgtttcagcccactccacttcattgaccgagactttctatttcgaaccggttcggttaaagacctagccacgagaccaactccgggctgtctcgtaaaagatcaattcccagatgctcttactcgacgcccacaggcaagcttgtttagagaaggagagttctcttcatcagggaaactgctcaacctccactatttccataagcatgattatgcactagcagacataaagtgccaagaagagaaaacgcataactcataagccaaagatgtattcgatcctgaattgaacgtaattttttccgattggttggaaggtaaggatagcatgattgactggttgcgggtcccttggatcatgggccacagctatttggatagattcagatcctttcatgtagtagagtctttgatgggctcggatccttttcatgatttcatgtgaggacacctttggcgggcttttttgatagatccaggatttctgtgcgatatcgatcttctctttatggctttggttaatctatcgtctagctgtcttggtcttccgaaaaggcgaagacaaacgcatggatttactttattctatgactaaaccagaatcaccccggagtgagctgttccataaggggctcatattatccgacagagcagagctatcatgccgaagaagcctttttctttctacgccccggtggcatcttgactttcctaggtctctaatagttccccataaaagagtcaatgggctgagctgatcgagtcccattttctggctgcaaggcccggcccgagtagtcaatggttgctaccgctcactgcgcttctctgtaccatttcatttctagtcaaaatggatgctgggcatatctactgacccgacaagctgacgtaattctatccatccgtagctgtctgtgccgctacctctatccagcagatccagtgccaaccgatctatatctagctttggccggccgggccaacccacctatacagagttgatgccatgcccgcctaaccacgaaagaaagcatccaatatttcaagactttctccacagagctctaaaatcctttctccgaagatccaggctcactttttcaggcaatggaatgacccgagcaaaggaaagggatcaaggcaataactacgcgcatcaaggtgatacctagaccgagcgaatctgaccgtagcctatcatactgagtgaaagcgtgccgaaccaagggaacttgcctttaatcttaggctcgcagctactaggtgcgtacccttgaacctagcccgccctagggtacaggcattgaaagacggctttcagaataggcttttttgtacgaagagaaggttacactactatataagataagtaattcattataagataagtaattcattgtgctaaaagaaccactttgaggatcaatcccttactgaatgaatgtccttttgatcagtgatcacagaaggagaaggcactgtgaatgagaacctctttcctttctggctaccaaacgtgctaataaaagagcttattctgagtttgaattcctcgaattctgtaagctagcttggtctacctgctttgttctgatttcattgtattcctccgtattcagcattcgcgccggtgtcacaaaaagcaaaagcatatcaattcgttgaggcaactagtcttggtaaggttttttccactgaatgagaagtttgtatgatccagatgttttgaaggcgtgtttgcccctgtgatacgcgtacgaggagtcgacggggaagagccgtgctggggttggaagaggttccagctttagaggagcctccctatcttatcccttgttggtcttatttgacagctcagctttgtctcgggcagattttggtccatgatggactctttttatttattttgacgattggatttctatatgaatggaaaaggggtgcttcggatcgggagtaaagtgatagggcacaaaatggggggaaaaagaaaggaaagagaataatgcccacgtttaatcaattgattcgtcatggtagagaagaaaaacggcgcacggaccgtactgaagttttggtctttggtttgctggttacacgtattatccgttttgtacattctgttttgtttcccatcccagtcttttgcagcataaaagtccttttagattccttttgttcgcttcctattataaacaaactttccaaaaaatggcaactgatttggttttatgttatttcagttattctctgtaaatctttatttgctgtaggatacttgtggatggacgacttaagtcgtgccatttctcagttctacccggtggtatccggaggactaggaggaggaaatacgccaatgcccccgacaaatccatctgagggtggtcttttagaaggatattatgctcatgagaatgagcactctcacgatcagcagaggggttcacctttctggtcgaaagagtacaaggaaagtggctcaaaacgccttttcttgaacctcgaggtagaggatcaaaacacagataccatcggggagcaagtaaaagcagagagtgataaatgcgaaaaaatcaaggcaaaaataatagcaaaaacacatgaactcttagtatccgaaggttaccatattccggatgaacgggatatagaacgagcaataaatgttgtgatgactgaacatgaaatgatcgatatcgatcggcgtaagaaaagattctactatctttattcccggttaggaaaaaacggagacaagttttgggtggagctactggaattgctgtctgactacgacataaataaaagcgattccgacgactaaaccgccatttcaggtttacgtcttttgttaggtctcgacttcttcgctatgatcttcccggtagttcatataggagctatagccgtttcattccttttcgttgttatgatgttccatattcaaatagcggagattcacgaagaagtattgcgctatttaccagtgagtgggattattggactgatcttttggtggtgagtttccttttttctttttttcgctatgcgccgctccgccagcaaggagtgccacgcacaagcagagcgaaaacaaacaaagcaggggagggggaattattcgttgggggaaatcctttgattgcgtattatagatccatgtctttcttgttccactagctaggacaaaatttgcacatgtccgtttcgttattacaaccttcttttttgatgtcaaagaccagaagctacgcgcaaattctcattgggtcttggttgttcttaacagcgatggctattcatttaagtcttggggtagcaccactagatcttcaacaaggtggaaattctcgtattctctatgtacatgttcctgcggctcggatgagtattattgtttatatcgccacggctataaacactttcttgttcctattaacaaaacatcccctttatcttcgctcttccggaaccggtatagaaatgggtgctttttttacgttgtttaccttagttactggggggtttcggggaagaccaatgtgggggaccttttgggtgtgggatgctcgtttgacctctgtattcatctcgtttcttatttacctgggtgcactgcgttttcaaaagcttcctgtcgaaccggcttctatttcaattcgtgctggaccgatcgatataccaataataaagtcttcagtcaactggtggaatacatcgcatcaacctgggagcattagccgatctggtacatcaatacatgttcctatgcccattccaatcttgtctaactttgctaacttccccttctcaacccgtatcttgtttgttctggaaacacgtcttcctattccatcttttctcgaatctcctataacggaagaaattgaagctcgagaaggaataccaaaacctagttcactcgctctctttgcatccatggctgaatggttaaagcgcccaacctaataaagaggcaagtaggttcgattcctgctggatgcacttggaacgttcagttcaatcgcagctcacagaatctaaagagatagctcgcccttatagcttatggggcatttcactcgctcaacactcgttcaaaacatccactcgttcaacaggaaagaaaaggtccaaaggatctacttctcaggatggaaagaagcaagaaagtctagagagtcgaaatgaccttggtccaaccatagtaggactgattcggaagattctatcctattcttctaaaaaggagttctctaatttaactggacttgaaagcggtggatcaagcccccctttttctttggctgtgtccaagtgaagtgaaactcgggaatgaagcagataggtctcagtcgaagaaaggtagccctattgggtctgggattgcttacctttctttccttctacagtacgccttaggttattctaaacctccactctcagtctacttttgaatcgattgccttacctataccgaccctactcaacaggggccgtgaactatgaaaagcctgccaggcagagaaaaaagtgcaaaagcgattgaacaaagtcgctccggtttggatgcagatgagggagagggtgaaagctttcatttaaaggtaaagggaagggaggaggacaagtagatcttatcctgcgtgcagtaagtatgaagaagagagccaggtcactagctaggtaagggtctacgattgctctgcctaccataaataattttaattgagcctatactctttggaaattactgaaagagaggcctaggattgctcacagatctgcttaaaggaacttaagataagtgctggacatgctttgttgaggggctcaaccaatcaatagcttcgcttacttccccagagtcttttgcctacttattgaccactgactcctagatcagctaacgactcttttgaaagcatacagatccccaatgacaatatcgtcacccgtgggattgggggctatgagttgaactatgcctgcaatccgttgacatgggtactattcttcagggactatcccacatcgacgacaactactctcttttctgtaaaagattgctgcttaaaaagaagtctgactcttcttatatcaatcccccttccttctggaatacgacagctactactttgattgaaaaattagaacgactgctgatgtgtaagcgggaggcatactttgatgtatcaagcgctacgcactaacttctgcgtccttcttcagacagaatatccttgctcccatctattggaaaatccactcagagactcaatagttgataatagttgaatagctcctccggtagccggactgtcattcccacttttttctgaccttccggttctgaatccgtaggacacttctctgttctcatgtatacctacacgagatctcgaacttgaaacgaaacatcactctcctctttattttacctttctctctatccaggggccaaactcacactttcaggagctatagcatacatggagccagcagggagagccttcttgaatagcaaaagccttaagcttcagactagttctaaccccgatccttcttcggcggatctgtccttgcctctttcctgatacaaaaacttgcttttcattttatatagatggaaaagttagcaatcctattttccttcgtaagagcacatcttacatcgcaaactttctctttatataccgacgatttctatcaaaatggcatcaatctcacaatgtggtttgagcaattctatgaccagcaaagactagaattcccttgtcatgaggtagtcttaggttcatgaatttttcgggattaaacaatgctaacttccttgctactagctgcttcttaaagtgtgtttgacacccaccagatccaatgaaactcacaagcttatcttcgtcagtggagttaacttgatcaatccacaacctcaaaactatacccatcagctttaccaacaacaaccaatccgtaagtaattctagagactgcccttgtagctttatctagttctggttgaacgagaactttataattaagcctactaatcatacctccaaccccccaacacagggaaaattctggggttccaaagctggcaggctaggttcccgtttcttcctcttcttaaccttctttcccttcacagctctaatgcctcgccagagctctttgacgaactcacttttcagcacaagttcttccaggatcaaaggatgccaaaaatcagatcttattaacttcctcgtggctgatctcgttggtcccatcttctccgcttgtttcagctgcaagcggaaacgtgtttatgaggaagatccttgacaatctaagatccttaccgtcttcctgattccctgtaaacccaattcatgaagctctcccattagcttcagaactctatcacgactgtaaaccttccctacccagtcccactgagcttgttcaggcgataatccacccggctcccacacatggttagctcgtccaggatcgcaaggtcgttcactcgctacacgagcgctcttcagcgacatactatcgtaaccaagatcaagcagaaattcccatgtccgaggtctagaacacaagggcaaagtaggagatcggaaacgcataccatatctcgcagaaggtcgtgtagagccatcgctagatctaaccttggacgagtgagctctgtcacgcttccctggttttcttgcccgagccctgcggtagttgcgcttgccaagaaaccttttcggaccgcgagatcgtcttgcccgaggagtcgcaaaagctccagatgcaggaaatcccttctgagttggaccgctcaccacctgctcgatgaatttcccaagcgacggatctgggtcttcctcagcttcaggatcggcggatctcttcatcgtcgtcatgcgatggaaaaaaacatctgctccacccgagcgagaatccgcctgatcagcgctatatcgttactatccaaacccattgtcgaaatcgtcgttggatacccacagtcagaagaccgaaggctctgataccatctgataagacccgagatggatcttctcggtagaatagagaaagagatgaaaatatagaagaaattgggagaaagcttggctgattcgagacgccactcttccatctttacatagcagcccctcttttttccgtataaccagattccaggttctttccctatcgggcttgttgtaacacagttcttaactccggatcagcttcaacttgagatagtaattctgctgcatcgaaagagggaggaggtgcgaatacaagttccaacagacgctcaggttgcactcgtcttgacaacgcatcagcagccttattttcagttcccggcttatactcaatgagaaaatcgaagcctaacagtttggtagcccatcctctgttgttccttggtgacaaacctttgttccagcaagtgctttagactcttctggtctgtgcgtatcgtgaaacgttgccctgatgtctccaacgttggactgccaagactattgctaagagctctcgttcgtacactgatttcaagctccccttttcagaaaacccttggctgagatacgcaacaggcctgttcccttgtaataaaacagctccaattccatttcccgacgcgggtcacaaaaggtagcttcaaatctggcaaggctagaacaggaagcgtcgtcactgctcctttgagagccttgaaagctagtgctgccatttctgtccattttaaactgttctttttgagtaactcggtcaacggtctcacaattttcccataattcttaacgaatctcctgtagtaccccgtcaagcccaagaagcctcgcaattctgttgtgttctttggttctggccaacccaccattgcttctaacttagctggatcagctgacaccccttcgcccgatataatatgtctatgtcccaaatatgcaatctgtggttgtccaaaagcacacttctttctgtttgcataaaactggtgttgttcccaaatctggagcaccattcccaagtgattcatgtgttcctccgtgcccttgctatagactagtatgtcatcaaaaaataccaacacaaacttccctgcggaaaatatcgttcatcacggattggaatgttgctggtgcgttggtaagcccaaatggcatgaccaggaactcatagtgcccttcgtgagttcgaaaggcagttttcttcacgtctgtggctcgtacacgtatttggtggtacccggatttgagatcgagtttggagaatacagaagctccttgtaactcatccaacagttcctcgatcacgggaattgggtacctgtctggtaccgtgagcttgtaaaaggctcggtaatccacgcgccgtaggccatcctccgtccttcttttggacgagcaaaactggacttgaatatggactgatgctcggctggatgatccgtgcttctaacatctccctaaccaatttttcaatctcgtccttctgagtatatgtataccggtaaggacggatgttaactggttctgctccttccttaaggttgatagcatgttccctgccacattttgggggtaatccttgcggcatctcaaacacgttttcatgccattccaacaactgtttcacttgagcatcctcaggaaaattttgagtcttaattcctcctgcaaaacagtgcggtgagctctaggagataataagccttccttccctctttgactaccgaattgagagagatttgagctcgcaccagtgacggatcgcctgctaaggtgacccactgatcttccctacggaaactcaaggtgtgtcttccccaattcattctggtgtcacccagagtagccaaccacgcataacccagcactatatccatggttacaggaagaagtccgcacgtatctgcacatcttggaccgttagctctactccgctgcatttcccggcacttggaacgacttgaccatttccaatagaaaccccaaatccacgagtttctgtgatttgcagaccacaccgatgtgctacactctctgctatgaaattgcttgtagcccctgaatcaattaaaacaatgacttcttgtcctgcaatttgtcctctcatcctcatggatctctcagttgttaaacctgccatcgaccgcaaagacaaccagagtaattcctttacttcatcctcatctgattcttctatctttttccctgtttcagcttcatcagcctcatccaactcatctccttcatccacagccatatactttaattctctgcccttacatctgtgaccaggattccacttgtcaccacaacgaaaacaaagccccttgctctttctatcctgatcaaacggtttccggtatggttccattttacgttctggggatcgggcgggcccggtgaagaagcattggatcccagagatggaatgggaaatggagatgttgaagaggcgggttgattagttctggttggagggctacgaactccttctcattgttccgctcctcttctcttctttaatggttgaccaggcactgaaggtcgatcatctgtgttcacctggtatggatataattgaagagtggaggtaaagggctcctgtcatccggcaatgcaagacccactccagatcgatgcctcttggtcagaccatttccgtatactgagattgacgacatagcgagaacaccgagatcattccgtaagagggtattgcagtggttattgaattgtcaacaatcctctcttcacatttgctagaaagaattttgagggcttctttggagagtgaatagctattctttttctcacatctcgatttccgccttctttggaaagataagagactttgctgctctcctcccaccttcaactaaggtagtcgcttagctaactaaaaaagcatcctctaacgagcacaccactgtatattttttttatttagataccctcaaagcaaaggtgaggaatagggctagctaacaagtaaacgagagacgtaagtgaacgaagttggcatcttctagctaagcaagcaaataaacaacttctctttgttgcgaagtgagccaggtaagcaaggaagtaatagaaagactctcaagtgtagctctatctaaacgcttcagcaaacccttgcgagcccaagtcaacttcggaccaacgaacttcatgtcatagagactagaggaatggaaccaactcaaacgacacggccgattaccactagctgagccaccccggctatctgaactacacagaatggaatgaaagtccccccacctattagccaaggatcagatatcatagatgccaagctactcaactgctcccagagagcacgccgcaaagtagcattaggactagcatagactgccgttacccaggacagaaaagcattattccgataaacactaaaatgaacatactggcgatgaacaatcttcacctccaactcagctttccaaagaagccaaatccccccagaaaaccctctatctccaagcccctttactaggttgggcaagcttggatgcccttactcccacaacaagttgctggtcgggatcgtgaaactctcgctcgaaaagtaagctggtccttgtttggtcataaggataatcgttcttattaggttaggggcggccggtccgggggttacccgcgattggtaatggcataagcagaagagggatagggggacaaggttacgcgctgggtagcgcagcgcatctgtttcgggtacagaggcgacgagggcgaagcaggccacccaacccaacaggtcagggttgggccggccataggttcgaatcctgccacctttcttgtggatcatcctgtggttaccggatgatgggaataacgaagcagaaatcttgaaatgagcacgaaatgtcaatatcaatatatgaattctttcattattcgttatttccgggtcttttcgttgcattcacttacaacaagaaacaaccaccagcgtttggtgcagcacctgcattttggtgcattcttctttctttccttggtctttcgttctgtcatattcctaataacttatccaattacaacgtattaaccgctaatgcacctttcttttatcaaatctcaggaacatggtctaatcatgagggtagtattttattatggtgtcggatcccaaatttttatggattttttctttgttaccggggtcgaccccagagccataatgtcttaaaacaaggaggccatagggaaagtcttttttttttttttgtctcgaacttcgtgaagaactcaattttatctctccctcgttacgaacaagaaagtggtttgaaaaaccagttgtacactcccttcgttctacgaacccttgttgattctgaacttcgttcgcgaaggaaccggacttttgacggaccagcccttttttatgcgccgctttatcctgaaaggaaaattaaaaatcctctggacgcttggcgctcccgtggttcgcgagaaggaaaaaggactcatcctttgttgcatctggcacgagatgataaagagagagcttcgtctatcgatgaacagcgaattgacggagctcttggcattgctttgtttttctctcctttcctatcagcgagttccgatccttttgttcgaaatttctttgtttgtaccgaaccgcttgcagaatcaaatcctgttccacaagatcctatatcagctatacatcctccttgcatttatgccggggacgtcgccagtgcggagggctttggcttatgtagatcaaaaatgatgaatgggattgtggcactccactcgccgccaatgcggaaggatgccgccgaaaagaatggaacgctgcttcgctctgctggatgcgtcggatcccgtataacaagcgagctttttaccctaaaattcaaacatgtgggcgcaaaatgctatcctgctctattgttacgtagcaatagaagcccgctcatgctgcttcggcggcgctttttcgccttctcttcgttctgggcaggagcgagaagccactcgactaaaaggtactgacgtaactctcaactaaaaaaaggagaggaaccctaatgactcgactaaaaggagaggaaccctaatgactcgactaaaaggagaggaaccctaatgactcgactaaaaggagaggaaccctagtgactcgactgaaaaggagaggataggagcgctagtggacacggggagggaaagaagactggaaccgtgcatctttgcttagcatggttcgacaaaagaaagaggtggaaaatggaccgagaaaataatgctttgtgaacccaattgctttgacaaaaatatatgaagaatcagtgctattgaggaacattttatagaaagaaaagaaaaagaagcaatagtaaagagagaagaaagcaagacttagaaagaagacaataagtaagagaactacgatttacttgattcccaaaggggtacgtaggcagccaaggacgaatcctggtccagttctttgctagtaagtgaggaaaatatatcacactttttttgaaaaaagttcgtagttaatctacctcggacgtacccatggcgtgtggggttcgcgtggggaaccgagtaaccaaagtcacgatcagtctaaggttgaaatctggatggtctttttgccagacgcgctggttcgagtccagctcgtgacaaaaggctaccctttctcttaagagaatatcgatatcctcaaaaatgagaaatggaaagcagcttcacatcacaagtgaggaagccaccggtgatcagctcaatgatcgtatacgctcaatagaatatgtacgcgcgggcgaaagaattaatgctgcttctgcccgcccctgcttctaagcctttgtcaccctcgccgcctattcattggattaaaggagcggtctgtataacatgagagaggaaacactagacgggaggatcaatttatagcacatgacagtagcatgacggaaggaatgacaagactaagcgaaatgccacctgaaaggacgaaaagaagagactgaagcaaaagccgaaaagaaaagcgtgactggactgaaggaatggagggaagctcttattaacggccaaagctaaactccgcttagcctggacagggacaaccaaagcaggaacttagagactcctagtaatacatcatacctactaaatcagtctattggggctataggtgttcccccggggaaaataaccaatggagttgattacgttgtgagtaaccgaggaaaggcgtaacattccatagttaagggtcgttcattagccctactagtcaagcacgggaagctaactttctatcaacaaagctagcggggtttccgggccttgttttggtccaatgtgaaaagctacatccgaggaatcgtatgattcagatacctgacgaaataaagagagaaaagatcgggatagctgggatgacctatttcaagatcagatgatccaccagcttgtctgcttgtgaggttgaggatttgactgttatgatctcttggcccgtgcctccgtagtgtagtgtaagttcttagaccaagattcgaaaccttgtctttcccgcttcccttcgcaggaaattttttacagaaagtagcgacactgataccttagaactaacaagtaccaggcctagaccggggagtcggaactaataacagcttttataaactccaaatccaactcttccaactccaagttgaacgcaggaaactctacctacaaccctcaattccggaggttggcagctcatcaactacgagaaaaatgtgatcgcaatcaagcacataacattgaatctcgtgcaagacattctttagctaagtctatagcagctgattcaatagcggatgtggtcttgttgaaggctttttgacttctattgagagcaaagtccttacttaccagaccgggctacttgaataagcagaaagaaaaaatgtcacgaacccaactcctaggtcactaggaagaagaatggagggaaatagaagaggtcctgtaaagaagctttcattcgatgcttctgattcaactcccagacaaacaaggaagtatgcgcgaagatagggttagtccctgcggcaggcattatccgggaacgattatccaggaacttacagaaggttggcgtgacacgcctaaatccacaacgcttcaggcgaagagatatatctttccgctttagcggcttgaacccttcgatcaagagataccttaaataaaatcaactaagtagctgacctcttagacgttcgtgggtattcaaattcatacataatcttctccgacatgagatagagtgagagggcctggcctattccatagaacaaactcagcaaatcttgatccgtattccacctcagatggtagaaggggcaactcagccttgtctttttctttgggctaggaacccaggagaatgttcaaagcgataagagaacaggtcttttcagagaagctcttgccgctcttctgttagagctctttagtcccattcctaacaacaggggactagctacagggaacaagggaacaagggaacaagctacacaggcactagcaactgggaacaagggaaacaccaactcccaacttccctagcccaaccttctcaacttccctagcttgcctggcccaaccttcccttcctttcctcacatccctaaccaactgacctaatccaccttcccctaacccaccttcttctttactaaacagagaaccagacccaccttcctctccatgttcttctacttccctctcaaataccgctttcttcatctacagttcttccactacctcaaaaccactcctctcaccccatgcttaccagatcaaaggctggcataaacaaactaaatcccaagtatagtctcactattactaccactattaaaaaagaaccaaaatctgttatttttgcccttaaggatccaggatggtgtcaagcaatgcaggaagaacttgatgctctctctcggaacaagacttggatacttgttccacctccagttaatcagaatattcttggttgtaaatgggtcttcaaaaccaaattacattctgatggtactcttgatcgcctaaaggctcgcttggttgctaaagggtttcatcaagaagaaggtatttactttgttgagacctacagtccggttgtgaggacagccactattcgtactatcttgaatgttgcacaacagttagaggttggccaatcaatcaattggatgttcaaaatgcatttctccatgggtatcttcaagaaaaagtttatatgcatcaatctcctggttttacgaatcctattcatccatcccatgtgtgtctgttgaaaaaggctctctacggattgaaacaggcgcctcgtgcttggttcgacaagtttagcgattttcgattttcttctggagtttgggtttgtctgcagctcagctgatccttctctgttcacgtatcacaacaattctgatgtcatgtatctgcttctctacgtggatgatattcttctcacgggcagttccaacactctgctcaatatgttgatctttcagctcagctccaccttctcaatgaaagaccttggaccagtccactattttctgggaattcagatcaaaactcatccttcgggtctgtttctatcccaaaccaagtatgctgaacagattctgaacaatgcagggatgttagattgcaaacctatgtctactcctctgccccttaagctcaactcctctgtttccactgctaagtatccggatccttcagactttcgcagcattgtaggtgctctccaatacttaactctcactcgaccagacataagttatgccgtgaacattgtctgtcagcgaatgcatgagcctacactcgctgattttgatctcctgaagcgtgtccttcgctatgttaaaggcaccatctttcatgggctgtatattcacaaaaatagcaagctcaatgttcaggccttctgtgatagtgactgggcaggatgtacatccacgaggaggtctacaactggattctgtacgtttctcggatgcaatattatctcctggtccgcaaaacgccagcctacagtgtctcgttcttctacggaaacggaatatcgagcccttgcactaacggctgcggagctcacttggtcatctgcttcgagatctcgggatccctcagcaatgaacactaactgaaagcggccgagaatgagtacctatcccttacgggaatcgaacccgtgtcttcgacatgaaaagacgatgtcctaaccactggacgaaagggaccaaaaggccattcttcatatacctcagctccgagaatagaagtggttgtggattcgaaccactgacacaaggatttacagtcctttgctctaaccagctgagctgaaccacttttccaaaagtctcttcttttcttcatcgaagagcgccctaccttaccacttgactagtaagggaaaagccctttactaatctaattaatagggaaaacttcttcgtcaagctttggagcagctctttcaattgacgactaatctcccaacatgctcaagaaccgagagccgcccagggactggacggccatagggagcttacttatgaagataggccggtcaaacaaaaaaacgcgcaacgggctccccgctcctagtcactaagtagtgctcttctcatttcgcccgcccgtttcacttccgcgccggaggaaatgggattcgaacccatgatacaatcttcttgtatgtcgatttagcaaaccaatgccttaagccactcagccatccctccaagttgttgatcggaattttttgtgcggttggttgcccgaagggggctatctgacccgatcaacttcgtaagccgtagcgcgctagcgcgcgtactcttcctctatctatgagcgagacaggcgttcatcatccagaaagatgcactgacgtcgtcccattgaatgaagatctgggcgaagtccgttggaattagccttgataaaaggtagctttttatttgacccctttcccttttttttgagagcaagcgcctaaaggaaggaaaataagaaaaaaaaagaggacgaagcaaactcgacaaaacacatcttttttttctatacgaaatttgttcgaccgggaatctcttggtgcgcttcgatactgttagcattcgcagtctgataagtggtggatttatgagggccccccatagctttttagaaccttggttattttacctaaaacgaaaagaaatcaacctaagattctgggagcggcgtcagtgactgactccttttatgcaattcgaaattataatgatggtcacaagtcactcaactcacttctttctctttcctcacacgtacttctatagcttgcttgatgactactctgaaagactgattgattctgatggatgatccatacgcgcgtgtacagttctttttgaatggcgaaatggctctcctggagtgagaaggcagatcgatgaggcacaagagtgctagttggactgaggtgggtgaaagattcaattcattctccatcttcaccgttaagcttcttgactagactttttgatctttctctgtctgacgctcgtcatctcatatcatcagataaaacgactattaatttcaagtcagtcagaatttgcgggatcttgactgtgaggagcaagaaaagaaagaagaactcatcaggcaagaaggggacttttcactctttcggagatgtaatagaagatgcagacttcgggcattcaaatgacttcctgttctggaatgtcaagccattagtagtagatgtcggcatttcctaaagaaagctgtttgagtagcaggaggacccgcggagcgctaatgaataatcgaaggcggattaagagaagagagctgttagcgtagatgaaagttgcgggttagtgctccaatatcctcagtagatagaggtagaagaagagctataacagtatacatagtaggtagcgagatcaaatcaaacctagtgcgtcactatcatcttacgcaccgatcggtctatctgatcaggttcagtatccaatcctgtgtagggcgggggagctgctagttcgctaggaaaatagaaaaagaatatagaaaatctataatcagtcaattgcaattggagaagaaagttagatatacttctcgctaatccttcttcttttgatcagcctagcatctccctcgtgcttatttattctttaacttttacctactgcaagacacatgcccatcccaagagcgctatgagttcatagagtggagaattcttcatggttcatccttttttcatgcaaggctagtacagatggtgagaatgctctggaagaaggtgtcccagtccgtaggggcactttcaatcaacccggtgggcgctcagtgactcgactgaaacgagaaggtacttaattggtccaacggaattctgctttatcatgaaagttatcgaccgaggaattccatttcggtagcaggcttctaaatacgctgcttgcccgaaccaaggaccttcacattctaatcaaagggaagatgctaagggtaccgataacttctgattatggattctatccaaggatcgggttctatctatgattggtgcgacgaatgcgatgactcttggttaaggccttgccttccctcatcgatcaaaatggccagtcacaattgttgcgccctgtctccctgccctgagtacgtcctggaaagcgaattcttaagcttggcccctctctttatttgaaatgctttagtgagattcacatctcgggaatattcttcgatacgagctactgtacctttatcttataagaacccttctctacaaccttcactattttattagtttctagtaagtaagtctcctgatgctacccagaagctccctcctgattctcgttgttaggtattttacttaggaaagagcagcactaatgggatatttttattaatggtattctgctaccctctccttttagtcgagtaatcaatccctctcctcatcaacaagtggaagagtcacgtcagtgcctaaaggtcagttttaaactccgagactgcagctccagcagaatccttccttggttcagattccttccctgccttgggatgccttactttctttaagggaaaagacagtatgatggtggtttttttccctgacttctgttttagtcgatcgagtagtaacccactagttattcaagcagttttctttcccctatccctttagctttagtcggccgagcaggttctaaccttttcttttggtcgagtaccttcgttcctcttccgagtggtcgagtaactcaagttcctcctctactaattagttgagccattcaggccacccgatccctgtccctaccggaagcctactgtctgactcttagcctagctacttagattagactgagcgaaactctgcagctgcttagttaagttctgctactgactctctttcagttgaggtggaatcaaacccttctttggcttaggaaaaaaaccacctctacttgttagtcttgctttttttcaattcttttggtcgaggagtaagcctcaccccaaaccgacactctttaacttaattacttttcttccggcggggcattttctttccttgcgtggatatcttttactagtgaaagcggcatcccaactgtcgaatgattgctaatcctcatttccaaaaagcataactcctatccgttgcatcagcctccatctggttccttcatttcagtcttagtccagcttgtaactaactccaaaccctctttctttcgagcgatgggatttgtgacgaaagcaaggaaaactcttagttgttgaatgcgagtcattacataggtggaattttataagcttctttaggcccggctagcccgtagagtcttaggggtttttccacttttcctgacgcaaggtcggggtctttacgaataggacaaatatacaccaaccctttgaaggatgaggttccagttcgccattcctattatttataggcttccagtctcctcagaagtccgctcttctatcttcgcagaattcacttgggtctcttactaaccttcgcatctagggcatgatgtctttatttaagatgtcaatcgtcttgttattttcaataaatttttccaggcctctctacgggattggaagaaggagaggagaaggagagagtgaaaggagataagtagatgttatcacagacggagatgccagtgagaatactgaacagacaacagctgaggatacacagcctaagctttttgaccataaaccatccaataataaagagaagatgtggaagggtgaaagatagtgtactaacgagaaaggtgaaaagctagggaaatttctgttcaagtttcagcttgatagctatatctttcctttcttaactgggttttttaacttcacatatagcccatcagcttgtgacttcgcacactctcagtttcgagattgggaatcgacaaaactgccctttcttaacttaattataaagggtagcttagctggttagatttactgaaggtaattcaatcgctgaacgttgataatagctttcgagaagagatccttactctccagctagttaaaacttccccgattagtaatgctctcaccctggggacatatctcacctttgtcagcaaaacagtagaaccatcttcatttctcagtctcacacttcctattccctttactgttgacatggtgtcatttgccatctttacttgtttcactaccagcatctgataaacttacaaaccattctcttcttccgaaagaacaacctgtgtcaagtatccagacttccctttgttaggaatccctaattgaaagtgagaagggacctacactagtatataaaggacatgggcctctccactcattgccaattggtttttagttggaagcccatgaacactcacatggtatcaagagccatggagggttctcttaagtcttatccttttccttccaatatcaatattactagttgtgtctccattaaactcaacgatcagaactatcttttatacgacgaaggaagggtgcgattgagtctgctgaacttgggcgagagatgtgacttcgttcctttcctttcagtcgagttatttaaacctctccagagctctggtgtctacgagaagcttcatgagtcaaacaattgaggaagccgatacttatactttggtagagaatctcgcataaagcaatgggagtcatggctcggattatgatcggactacaaggaaaaacaatgatgaatctcatcatgccatccaagagctgaatgcaaaaatggataagatattgaagcgtgaccaaaagaaaagatgacggtaaactcttgtgaagagtatggtggatatcaagggtaccaagactttggtgttgaagggtatgaggagccacaagaagagttgaactatgttggaggtcaaggattccaaccaaggcctttcaacgaagggttccaagctagaggggctactgctccaacaaagaccaccttaccaagcgccctaccaagcaccttaccaagccccttaccaagctcaagggagttctttttctgctccaactgcaccagatagtgaggtgaagctaatgttgcaacaattccttgaaggacaaaagaaaagtaccattgagatgaacacaaagatggacaacatgtacaatgatcttaatgggaagttttaaactttggcctctcatgtcaaatctcttgacaaccaagttgcttaaaccgcctcttcatcaaagagacccatgggaacactacccggtaaaccggaagcaaacccaagggaacattttacataatgcttagaagtggaaaagagcttgaggaagttgtgagagatgataaggaagaggagcaagttgttgtgagaaaggctaaacagatcgtcaactttcccttgcttggcatgctctcatcagcaaggtatggcttaaggcgctggccattcaccgtgaagtgttcaccattgacatcccaaagcactaccgctccatacggtttcacttcctttatgcgaaagggtaaaaaacatctagatctcaactttcctggaaataacttgagtctagagttgaggagcagcacttggtcatttaccttgaactcccttggtaagatcttcttataatgccaagccttagtcctctccttgtagatctttgtgttctcgtaggcctcttgccttatttcgtcgaggtggttcaattggaccaaccgcctttccgaagcggtttttatgtcatagttcaacaattttgtagcccaaaaagctttgtgctcaatctcaaccggcaaatggcaagacttcccatagacaagattgaaaggtgtggttcttatgggtgtcttgtatgccgtcctatatgcccatagcgcatcgtcaagcttggtggaccaatcctttcttgttttcccaaccgtcttctcgctttgatttatcggttggagatttccacttggccacttgtttgaggatggtaaggagtggcaaccttatgcttcacaccatgttttcttcaaaaggttctcaaaaactttgttgatgaagtgagatcccccatcactaataaccactcgtggtataccgaatcttgggaaaatcactttcttaaacatttttagcacaaccttggcgtcattagtggggctcgcaagagcttccacccatttttaaacataatctaccgccattaggatgtattggtttccatgagaagatggtttttttcatgaaatagatgccccacacatcaaatacttctacttccaagataaagtgttgtggcatctcattcctctttgtaaagttgcccttcctttggcaagcgtcgcaagaagaaacaaacccatgagcatccttgaacgtggttggccaatagaatcctgcttgtaaaacaaaccttggccactgttttaaatgttgcgaaatgtcctgcatactccgatgcatgcatggcaatggtagagaatgcccttcacttcctcttttgaaatgcatctcctaaaaagaccatcggagcatctcttatacaaaaatggctcatccaaaaaataatgttgcacatctcgcaagaatttcttcttcctatatccatggaacattggaggctcttgatcacaagccaagtaattaaaaaaatcggcataccatggaaggtcatcttccatgctttccaaaatcataaccgcgggatactcttccttcaaatattcgagcacataatagactttctcttcggggaggctatcatctatcggtatgtcctcctcgacccgaagtctagacaagtgattcgcgactccattctcaattcctttcttgtcctttataaccaaatcaaactcttggagaagtagaatccatctaagtagcctcggtttcgcgtccttctttgccaataagtatctcaaagccgcgtggtccgtgtgcactattactttggagcccaccaagtaagaccgacctaaacttctcaaaggcgaaaactatggcgaggagcgtaagcgcggtggtggcatagttgacttgcgcgtcgtccaaggttctactagcctcatcttttccccctccccggatccatcatcctcgaggaggaggaaatctaagtccaagactcttttagtaagactatggattgctaatctgcctacgcggaaaaggaagccttctccctctcaaactaaagagtaaagatagcccttccttgccctaaaatacatgtaacattggatttgctagtattcctacggggcttacccccagagccatcctaatccatcttgctaatgttcctaatccatctttgctaatgttccggtcttcaaacaagaaagagctagggggctcgttcgacctgacgctggttagacgtgaggtcgaacatgtcccgcttcgccctatggcactaagtagatggcgctcaacttcctgtccttcctttgccccaaaacggctccaaccgcgtagtcacttgcatcgcacatgacctcaaatggtaaattccagttggactatgggcgcggtcactagagcctctttaagcatcaagaatgcctcaaggcatttctcatcaaacacaaaagccacatctttgcataagagttgtgtgagtggcctagcaatcttcgataaatccttgagaaatcttctataaaaccctaatgtcctaagaagcttcgaataccctttaccaagtttggtggttgcaaacttgtcatcacctcaatcttcgcttggtcaacgaattttttacttgttttgaacagtattctaaagacacgtcttacgaaaagcagatttaattttttgaggaaattattaagtgggattctgaaacgtataattacagcttgcacttttaacgaggaactctcgcaattagctctactttctttctttctggttttggtgttccgatatctttcgtaggatgagttcgatccattaggttcttcaatttgttcagaaaagaaacaagaaagaagaaaacatctttgattacgattaaaaggaacaatctcaaatagaccaagatctaatttcgggtcatttcttggtgaacatgatctgccataatctcttcgattccttcatttatgtgccagaataaagatagatttggtaggaaagtggaagagactttattgtatatgataatcaaagggagtgggaaagctgcagtaattctttggaaaagcccggttctctttgtcttcgagctttcattttgtaatccactctttcgttccttcatatacctccccaccaatagatagagacaaataggaataaccaaactacgtctacaaaatgccagtaccatgcagctgcttcaaagccaacgtgatgctccttcgtcagatgaccaagatattgccgaataccacatataatcaagaaaagagtacctataatcacatgaaaaccatgaaagcctgttgctaagaaaaaggtagaaccataaatactatccgaaatagtgaagggtgcttgataatattccattccttgaaagccagtaaatactagagccaataaaacggtagctactaaagcataaactgctcgtttttctttccccgcgagtatagcatgatgagcccaagttacggcagctccggatgaagggagaataggggtattaagaaaagggatttcccaaggatctaaaacctcaatcccttttgggggccaaatacctccgatctctaccgcaggtgccaaagaagaatgagaagaagcccaaaaaaaagcaaaaaagaacataacctccgatacgatgaacagaatagaaccatatcgaggtcctaattgtacgactttggtatgatgtccttccaacgtggattcacgtagaacatcgcgccaccatacgaacatggtatataggataaatatgaggcccaaacttagaagtcttgcacccccttgaaatgggtgcatgtacatcacacctcctacggtggttgccaaagctccgagtgaacccgaaataggccatggacttggatctaccaaatgataagaatgcctctgagattcaatcataaaccactttgtctcggttatatgtaaacccccacccttcacccccaccgggctctttatctttggggtctaattttctttctatctgacaggacaaactaataggaagggatggttctttaattgcattgatagaagttctaactagaaaaggatctctctattactttgagaagagaatcgttggtttgaccgacggaaagcatgggagaaagaaagatgcacaaacagacttaaatctatgaaaagaaagaagagaacgaacgaacggatttagttctggggaggttggtcctcgtgtgcatggatgagcacacggagacaccaattaaggaacgcacggcgtgcgctttcctcctctatccctgctaattccgtattaaaccttcccctccactcggcgatttgccgatcccgaatggaatcagctcttcgaccgagatggatttgtcgttggagggctcgtatttcctgatccaggcgcgcggttaattcccgacgccggcctggatccccctcgttctggagggcccgttccgtcccctcgacccgttcccaagactccgacaataggcgattccgtgctcgtaaagagtcggaactctctatttcgttgtacaacgacgatacggagggattgagagcaatctcgttaccctccgtatcggcaggcaggtctacctgtggaacgacaaataaagtgggggtttccagaaacccaagaagacataacgagagtctcaataataagataactcgccctaacttcggggctatgaaaacaagaaagtaatataccacacccaaacaacttttagtgccatatcttccaaaacccagttttgtaccatccggtttgcaacccctactacatctgcctttacgatatttactatatttcgtacgtttcggatatagcacgtctcccttttttttgactatatgaaatccacactttgacacctgagattccgtaacgagtagatacttccgcaggagcataatcgattttatggttaaatacattacgagaagtttttctatgcttatagcatttatactttcgtggtcgccctcactgaaccgacttgaatctgaactacgattttgttccccaacttgcttgattaacgggcattttcggggactagcccgcttcttcattaaaaaagagggcgattgcccggtccttggaatcattttagatcgtatccccaagcctgcctccactttcttatgtgaaagaggtgcttgctttatgagactgaatggaaaccttctttcttcgatcagaatacgaataagatcaaaaaggccatcattggggcaaacaatgcaatagcttcggttagtaaaggaattccatccactccggcttagctttcaaccggtctttttaggttacgaacgcctagtcgacataatgtctggcgtttacctgatggttccccaagcccctgagctcatcaatgaacggattccacctttcacagcgagctgttccgaagttgcgcctgagcacagtgaaatgcctcttacggtcatctatagcgtgctcccagtcgtcatgtagagccaactggagagcacgcttgacatcctctggatcctctagagttatccctcgttgatgcaggagaatttgggctttccgtaccatggccgcctccaaattctcgcaggcgctcgtgatagtctctacctcggcagagatgcggtcgtgctcttgtgcccgagcctccctttcccaagcctgctcctcaggaatcggttgattgaccgacgaggaggtacgcccggaactggccgaatcttcgaccatatcggatgtatacgtgaaccattctgaggaggaagatgccccgccaggtcctacgccataccatagaaggggttctaacaggagcaaagcctgaccacccagtagatagacgactttgatccggatcaaagatagcacgaaccccactaagaagagatagagaatcctcttcagcggtcctttcttacgaaatccaaatataaataccactagcgcacagaatgaaacgcacgtagtgatcattatagcgcttccttctgatcctagaaaacgtccgaaaaaacctgctacggaaccaccgaggagaggcaaaaatagtcgaagcatatcaatattaatcattttatattttttcattttctttaagctgttgcactaaggttacttaagaagattcccagaatattgactcatttactctcaggtgcacttaaataatttacggcgagctcttccgaggaatgcttacaatagaagtggttgtggattcgaaccactgacagacggattttcagtccttcactcgaccagagctattacctgtcaccactttcttttcaactcgtaaaggtaaagaaaggatccgcctcaactaactgatctatcaacttgatttcttctcttatgagattcttttttagtgatagttagaggtccgaaaaacgagagggaagaactcgactatttctctgatttccagcaacagctctttctatctttctggctgttctacctacccatctctttcctggttactcgatagatcttcccctgggatggatcctgggctacttaagatcggatcaacttcccatttgcttactagcacaccccggcatcctcccaactgcgcgcacctgtttccggccctgccaagagagatcttcttcctttgtgctgcactgaacactctccgaatcatcttggcactcatcaaactatgctttttttccttgcactaaacactttgttaatcgtctgagcagcaaacgtacaactatctctttgtccgtctgtgaacaagtagtatgagccagttaagtgagcgaagcaaccctgagctcctcagcacactcctgctttctcctcaacatcaacattcaaatgttgtaacacttgactatattttaaaaccagaaacacaatcgattcaaaacgattaatcaatcaatgaaaaaagacgagaagggttgatcaattgtcgggtttgggactcattgattctccgcttcatacgaggggaatcacacttcaaatcaatcaaatcaaccaatcctatcaatacatgatatgttgaaattgtaatcatcgacgattatttcttggttgatccttgtcgaggggaggattgatccaagccgtactcaactcaacaatcgctattatctaccttacaccttcgatcgtcaactcaaatccatcgcttttatatacattactatcgatcgacgaaaaccaacatcacacttttcatgtttcatatcgacttggtggtagatccctggcaagaagcagcagaggaaaggaaagaggaaagcttcaatcaaatttctcgtcagttgataatcgacttgttggtagaaggtgggagatatccctgctaattcggaatgaaaagaaagaaccaatcttcgtaattcgagatgatatcaattggagattcatctatctcccacaataaacttctacttttaggttgctcatcgaaatgtctatagtcgaaaacccacgtttcgaggggtatgaaggtgataggacctctgaaatataagggtaggaagattgaacaccacttatcagggccaactcaactcatattggtgtggcatgtgttggcatgttgacatattgggcaggagcccttacctctatcaagtcaaagtataaatccctgcgaaaagaaaaggaaaagcaaaagatcaagaaaagtcaaagttgctgcgctaggaattgggaaattaaggatgacagaaatgggagatcaatcacctgttgtatctatcccatccaagaaagctgggcatccgacccaataaagtatcagatttagggtaggtccttgtaaaaacctttcaagttgcttactggcaatcgcacgtttcataacttttcaggtgctgatacccctaaaactgaagagccaataaaaacgaagggtacctttcaagggataggtcccgggattagcagctttgtgctagctcctactattggcagatgcgtgacagcacgcacgtgtaagataaagtcaagaacttcctttgatgcgctagggatgcgtaagggcaagcatcagaaaaaaagaattctgatttctcatattacccggggtccatccctgcgaaaagagaggaaaagcataagatcaagaaaagggaaaagagaaatcctctgattaccaaaagaagaagaaccggtttcagaagaggtccaaaggaactcaacttaaattgctgctttaaaaagaggaagacttagattactcagatgacaaggggatgtttacagttctgcttattgtcctgcattaccagctgatttaaactagataaacatatgtgatcaataaaagcaaaagatggaaatgattgattggataatcggtggcatactattcaaagatgtacgaatcacgcctttaatcaatagaggtgcacttgtcgaactttgatctaaaaggaagcaggagtggaaagccagcacactgctatggaagataagacggctcatagacgaaagaaagttaacagatcaggatctccaagcctatcgaagaccgtaggaggagtgtgctggaagactggttgggtctcgattctttccaaagcaggccgcttttctttagatttagaggtaccagcctcatcgacagggagctcaagtcgctctaaagctggccctttatctttagcatttgaatgattacccgctgcttcacgaggagtgtgctgaattgggttttcttcaaggatcctttcaagggctggacgacgtttagacgaagacaggtctttgcttgcgtctaaaggagatgttctaggtgtgtgctgacgactaaatgcagcactgtgctagaggagaagctacttaaaattgctgcgcttcatttgctgcgctaggagtgaagcctttccatcgcaagtgaactggagattcaacagaagccgaacctcagtagattggactcctatagttgtagcgaacaggtttagagcaatttctgttcaagtttcagcttgatagctagggattaatgcagcacattggtagaaagagctacatatgagatgaacctgtgtgctgcacaaaagggaagcagcttccaactttaacccttgaaactggtacatcagtgtgctcaactacgaagacagccaagccaaacaaaccagccagcctgctaagcaaagtcaaagctaaatctctttccggcaaggctatactcacttctagtgtacgagtgctgctgcttcttggcctcgctcttgctttgcaaagatgggtcgcagcctggcactctcagtcccagaactaacaatctcagaactaagaatcaaagaatcccagaactttgaattcaagaactagggagataagtggtgagttgggaaggaatgttaggagcctagacccttcccttacccagacccagaactaggaatcttataactaggaatgtgagtaaccctgaccctaagccagagaagttgggtaagtgaatgtgaattagaagaagtttgaatgaagggaatgtaagtgagtgaagcaagaacaatgctagccataggggttcctccagcttcgctgaagaagctaggttcctccgcaactaagccagtgaccaatgaaatgaggggagagtagctgatgaaatgaggggtgagtacgtagattgtaaaccaactcatgggctattaaaatattgtcagatataagcctttccgaaacaaatgcagactgtgtaggagacacaagggaaggcagaatcggtttgagtctggccaccatgatctttgatatgatcttatacatgactgagcaaagactaatgggtcgcatctatgtcattaaccgaggattgagcttcttggggattaagcaaatctgagtcaaattccaatccaccggaaaggatcctgttcgaaaaaaattcctctcctcctggtagtagctattaatgagtgatcggctgctaggacaagagggcaatagcaccgaggaacgcctctgatcttccttgcgtctgtctcttccgatttcttatccgctttgagctctgttagtagcttgacttcctctagtagctagtttagagttcctatcctagctgctagctcttctttcctcgtagctctcttcttgtagctaggcagttagttgttcctatccgactagtaggaagcgcggctatggaactaacagaatagatagagcggcaaccaatgctattaggagttcttttcggtttctatactagcagctagtagtcctatccctattagctttcttgttggcattcctttcgtagttagaatgccatatacttgaattccattcggtcttgctgagcttagaaaagcgctcctttctcacctatgtactctgttaccttaggaatatcaaagggttggaccattgtctggaatgcaggtatataattgtcgggagtgagcctagcttcccttcccgtgcctagctctcctggttccatccatcgtgagaaggaagtgcaatgattttgcagtctgccaggctgtcggaggctcctggcgcaaactgggaaaaggacgatgacaacccgatatttagaggtagagggaactttcggtgggcaatcaataaagaggatctgccagcactaataagtggaaagaagtctcagaaagggagaaggcacctccttctacaagcagtttgtattttgtggtgaaggagaaaaggatggtgaattcaggtcgctgatctcttctcatcctacactatggatagagctagggttggcaaagaacccatgtgccggctcgctttttatttagagattcaacctattgtgacaaatgaaagtaggaagacgtccgcgcttactctactagaactcctattctagctcttcgttctgactattacccgggaacggactggcacttctaaaaagctatttaggggaaaaagaaaaaaagaacccctccctccttcctcgcctactctttgccgttgggcctaatttcattcaattagaatatctgaggggacaaatcgaatgaataagggttgccgagccaagaattcgatccgtttttggaaatcagactgagctactcaggtgaatccagtgaaaaaagatctaatccgaaagagcttcaagcttagaaatgttctgttcagaaggggagaagggctaccttctttcagatgaaaagttgaccgaggggccagtactgtgccagtagggaccactggtaggctctttctgatggcaggacgacgtgggcgcacgcctgaaagcagcttgaaataaccttcctctttcctctctggattctctggagagggtcttcccctgcctctcagagtagggttccattctgcaagatcaaaatagaatagaaagaagtcgtcttctacgataaggtactttctgttttgagatctcgtagcggctcttatcgagaatgcgaattccaatcagactctaaagtggagtccgtgccccttccaaaggtctcagaggagtaccaaaaggtgccatagtcgtcgcaaaggttcaagcaaggaggaagtctcatttcaggggggggtttcagaattcccaagcgcctagtcagttgaagggtcagttccaggttagcgtccgattgtgcgctctgaataaatctagatgcggaaggagaaggtcaggggtagccgatgttagcaacctggctacacttctttttagtgaaaggtgagctacggtgccccaaacttctaggagtagagatctcgtctctgcaggttcggagctcctatctccgtaccgagcaaagcacaggtaataaatctctgggttcggtcttccggtggacggggtggatcgtaagctccttctcctgagtcgacctgagagggctcttccttgcctgttcttctagttgatggttccttctttccattccttgggaatggtgtccgtgctactgaatccctcattcatctgctgtggtctccccctgacctggtgagagtcagccaaccccagctagatggaatatccattattctgatgattctattctgcattctccgttcaaaaccgtctactcactaaagaaggaacagtagatagtagtgcttctagaagagccctcttgggtgaccggatgagagtccgagccttcgaacctcgggcttttttctcttctttcacttcactcaccttattcaactgtgtattttgggaggacctttgacttcctctaagactattggggcctattaataaaccgaggggacccccaggctctggatgacaaagcagctcggaccttccatcaacaggtcaggccaacaactcggggctgttgatttgatgggactcactgagagatgggagttatttttttttccagagtagacaggcttggaggggaggaagccctcgtcaggtacactttctgagcttggtgttacgtggatagtaggggggaagggctcgcatcagaggggctctcacctctgtgcagcaaatcgaggtctcgacgagcctctgccgattggacccggggacctaagctttgctaaagcaaaaggggttaactttttttgactagttggactggttcgcctaatcgatcagcccctaccttattcaccgtactagatttccatattgtgtaaagcgcccacctcggatacgaaagaaggacaggagtggttccactagccgatgcttatcagcccttcccagcctcatccgtacctgaataatagtcaatcagttgccgaatcggcatgaagccttctcaagttccatcctctctttcccacggataagcggttgccggaagcgactttaatgggcaagacttcctcgtcgggccaccttcaatctcaatctccatttgctaccttctactctttcaatagaaggtcatcagtcccccgagactaaactcaggtaagcttctttgaaggggggggggaagtgtgctgactctactttaaaggagagggacgagactcgactaagaatccgttagccttaagagaataggccctttttcattgagttcttttcccgattgccttggcttattactcagacgagtttgataaaaagtccagtgaataccctgtgattcagagagggaatccggtctttagacagcccttgcttcttggctgtggatagggctttgactctcttgctagaaagctaaccctttacctttatccggtactcggcggaagagtgctgtacagccggctctggactttccgctttgatagatagatctgacctccctcactctctcatcccttagagaaaaaaaaacagatatggaaccttctctcgctctgaaacttccataacactactagtaaaattcctcttattcatcttcgccaggctctgggattcctattctatctagaacagagaagaaggggcgtagctcttctatcggcttcttattagtcgtcgtctgactcttttagagaccagaaactctccgttcttgcatcagggcgcagtactaattgattctttcatcgtctttgattgctttcttgattgctaacccctagccaaccctttcctcagctgatgccgacatgcctcttttgggttattctctaatcacatctgggaagactcctctttccactcggatcaaaaagctgatcactgtgaaggcagatttatagccataaagatgatcaggccttagtgccccggggcaaaaagccacgctttgctcttgatggtcaactcgaaaaaggtttgaataacttatgttggaaggctttgtctacggtcttgttctcttaactaagattccattcgtcgaaacagaagtacggccagcccttttttatatatctcttttgtaagacgccctgcctgaatataataccttatcctggcccgacaagccagttggagtggtagttcactgttttccaagcgcatctagctcaattcttgttggaaggctacctcgggatatggcaatgaagcctatctgtggctatagtttcctgagtgaggggattggagagtacgacatatcctttgaggcaggttattatcagatattttctttcctaaaagagatgcctatctagttgatgtgattagtgcttcagtctattagactaggccctacctttatatgctatgggaacctagcttgttatgctacggtttttatggtggatactggtcctgttaggtcggtattgtacagttgatggggctgctacctaagtgctggacttttacggactggtaccaaccactgatgggtgaaattatgctattattgggtctgacctttagctggccgattgtccaggaaaaagtgattacttcaagtcttcgccaccgctatcgtaattaggtttcatgctggcattcgaggcaagctattggatctgacataaatggtcaatattagtctatttcatcgagctgactgaaacctatttctagaagttggatctgaatagttacgtgatgtctggttgaccgattgattacaaatattcgacacaaccgatgtacgtgaatgggtaactacttttcggttccttactatgatatacggatagttaactatatatagatataattaaggaacgtcatgcttgtcatgcttctctttctgtagtcctccaactaagccgagcgaggtgaagcgaacccagccaatcagtcaagtcggggcaagctaaggcagctacgctaatcaagtggagcataagtcacacgaatactgaaactcgaagtcaaagagaaagatcatttagaacgataagggtgaaagttaaattggttgaaacattcagaatatagaagccggtcgaaacaagttgaagagagccaggtcgagggaagggaaatgtgaatcgcccatttttgtttgatgggattattcttgagtggagtacgattgctctgctttatgctttgactcgagtgactgatggaatgtgatgagtctcctttttctcccatgctggtattgtttgattgtccttagttggattggtccttgcattgcttttcttccttgctcgggtgagtggacttctaagtaaaggaatccatttaccggtaatctttctgcttagcttggtagtacgaatgcggagcctgacttgctaatcccgatgtgattgttccttggtaggtttccttgaatctagtgcaattgttaggtgtcaaagtctacattgattattggtctacgccgcttggcttactttctcggttccttcttagtctaagtcgagtagtctataccacgggcatctttatgctgctgagcctagtttgggtgtgaatcttgagcctgacttgcatatatgctttgctggcgtaagtgccaaatgtgctgattggttggtcctgctatgctgagaagtcggctggaagagtgcaaattgtgttttatgtttcacttgccgggctgagctggatggggaatgttccttgcctcgggtcatagtttgttggctgctcgcctgttatggagctgggctattagtttgaagctgggctccttgcgattattttgctgggctcggaaaagtttttgttcccaaactgagttctacctgaggatctttcctggcctccttaaccgatagaatgggactagtcaaaggttggcaaactacttcgcattggccttttcttcttccgtgctttccttaacttcatgcttttctgcttagattgctgaaatccaataacaataattagaaggaatgttgaaatgaaatagaagatagaaatccaataatccaatagaatagaaagaatagaagatagtacatatgcactcttagttcagcccttcggatggtatgaaaggtatgaatatcttgctcgcataaaccgggccttcattgcctggcactactctctaatttgataactaaaaaaagtgcttccgctgctgagcaaactttgtagtctgtattcccatcaggcctaaacttttcgactaaaagctaaggggctaatactctatgccaccctgagttgacttgagattattggattgtgccgatggctgaagtgtcaacttcttttgtgccgcaacccgctgctacttagttccctagctagattcagctgtgccaggcaactccccgatttgtctaatgacaacctatttatctgtcaaagccacaacccttccctctgcgaagtcactccaagtctgcaccaaattccggaatcgagatggagggctaacggctaaagctatgccgaagacaatgctgatgacgaaaacaatgaggcggatttcggactgtgttttgactacaagggataactccacctgatccctcgcttttccactaaatgggcgctcactaacacatagaagggaggctagctacaaagaggtcaaaccttgcgattgccattctactgcttccccccaatggggatactaccaactcccttatggttagtcccattattgatgtgacttctttgttttgaagaagcatctcagtctattcttctactcgccttatttgtccaagtataggaataaaaagagaagtttttgtcttctgactaggattgcgttagcctaacttggtctgttcatcgcgacgaggagcagcagcggcaacatcacataatcaatcgaatcccacctatctagcatcaaagtaacggagggtagcgttttagcccaactcatggaatactacaaagagctaccaatgcaaaagaacaaacatggggagcagcaagagcaagatgacaagcggagtaaagcagcgatggaaagcatcaatgcgacaaagcaacagtcgaagaaacagcaagggcaaactactatcgtccgggcgctaatcaatacgaaaagagggacacgcatctcgagaccttacctcgtcgagtcgtcgagagcagtgatcgggagggactgacgaccttcattctggtcctggaatcctttcaatttgaaacgcgaaaggtgcccaatctcatcaccggtgcctgcagccaattagctagacccaggctcgtgattagcccaagccaagaagctaagaactggaatactggcatgccctgtgccctttcttcgattggatcttgaccctgaaatgctcctatacccggaaatagttctcaatggacttgaccactcttgatagtcaaccgatgcaccatgctatagaatgctccttagtgctactggctgataccatatgactacattacttttagaaatgactctacgcgagatgactctatactcaaccgataaacagtcacatcatttttctctgtgttaagtttgatatgtgatttttctgtaaaatccttagcaatttctactccctctcctctgtttaggaatgatcgtaggaccttctctcttcctttgactaccgatagtgttgctcgggagttttcgttcctttggcttaaaagcatacgtacttgcttcagaatgcactggagtccccgtttagaacaaaagttagttagggtcgcgagatgggctgtcatgcaaaacccggtccagggctctcgtccttatatagaagcgtgaatatgctctctttccgccaccaaatggtgggaccacgacgctaaagcagacagtgcagacactaattcctattatgaccagctcatttcagacaagtctatcccatgcttccatctgataaagggttaattagtcgatcgttaacaaaagtcaaatcgagtccagcagccacagctcctcggctaatctaagtccttactttgcatgtcaatcctagagcgaaaatgaaatgaagttgacagagacaagtggctttttcattggctgcttgggcttggatcccggcttgctcctcaattgtgggagttggtcaccattgtttcgtcaccatattgagtgctattatagaatagtgggaattaaagtcagatgccatttccttgacacatttacatctccttagatcttgagatgagcgtcacgatctataccgatcccatgcagtagtgggcttatcgagaaatccattccatctcccatagcgagaaagttaccaacgcgatttcctttcgtaagacctatattggaattgcaaaagttcatctcctatagttatagtagcaaaacctttaaagcctcttttcttccctagaggcaccagagtaagctgggcaagggcacagtgcagagaaaggagaaagcagctgagctatggaagcatgagatcttgaagctatgataaccgtgctagtcgtgatgacgtaattgatatacaaaaggttcttttattgatgctgatgagctggctcaactatgacatttgaatacccttgcctctgcacgacatatggatcgaccactgcatccatagaacacgtgcgaatgtatgatcaaaagtactttccgtcttgggaattggtagaatcagaaatgagtgcttcatacagatctatgattagactaagttagggtaccagtggtgtcgtttgcagggcttgccaagggcgctacaccgccatgataagtactcgtaggaaacgcgtgggtacttttgagcgtcagatcctgtaggttgataggacttccgtccaactatccaaagaatatatgatatgctgaacacatacaagttgacatggtgacacaaagctcttcgcctgcttcacgtggtcacggtatgggcgaaagggtctatcatcacatggaaaacaatcgagcctaccgcctcacagaagcaaagtaaatatcatggcacgtcaaggtgctactaaccacttttttagcctaatcttaaaaaacagaaaagcgatagcgaatttctagtctgcccagatggtggtatccgtgactgctccgtgaattccgctaagtaaccgcgagtgctgcgtcggcgtacaggtgggagtcttcttctttcttgttgaagaagcgaagaggtgaggtttggatttggattggtctcttaggttgttccttcggtcctcttcctctttctcgaatcaaccgtagagctaggattggaaagagggggaattaggctgctggtaggtgggagaataggcttttgctcttttagattgaaaaggaaccgacacgtagtagtccggtccgtaaattccagcctttattaagccgctgaaaggctcttcaagaccacatacgctggggaaaataatcaacattataggcaagattgaaatgcaatccattccactttagtatcctgacctgaaggtgatcaccggaacgatgacactgagcgagaaaacccttttttagggaaacctagctttctctaacaaacttatttcataactttgatagaggaatcattcgaaagttcggatggatggagccttagcctttcactaatagacagaagtgacatagttgctctacgaagagcaggcaatattcttttcggactaagcccactagttaagatatgcacagctgctaaagcaactgccaattcccagaagaaagaagcctaacctattatattatagaggccctccactctgctagctgtgcccactagattaataaagtagagttccgcctgtcttttcttttgatgtaggcttccacaggttccactctcatcctttattctcttgatactgatattgatagtcttccttgcccttctttctgtgagtgtagcgtggaagtctttgatattgtggtcccaatccttttctgtatccgttcaacttatccaatttgataatatactcttctgctctgcgagcctttcattgaactggaaaaaggatagctgggattgaatggcgtctagttcttctatggcctttcttattcttttatcgaccttcaacttttgaattcaaggcttttagcgcagctttgacaaatcgaagcttctgggcgggttcccttaaaaggttgccagggaaatattttgaggaggttttcttgctggggtttcggccgggtttacctactattggatttgaaccaatgactctcgccgtatgaaagcgatactctaaccgctgagtcaagtaggtcaagctgagtcaagtcagagaaaatagacccctaaaggaggacctattgaataagtctccaatcaatcgtaggcgggtgagcgacttcttttctttcttttttgagctctcacctttagccgatcttattcaatggattgtgactttctcagctttagttttctatcgaatttccatttgggctcattggactcttttatctaaacttgagcccgaagcgagtgaaactcgtccttcatttcatacctcagtccggtgcctatgaaaaaacccatgacccttcgattgaaagaaagatctccgctctccttctttcgaagttgtaaactggtcgagtcagcttcgttgctatttattagtagtctcaaagtcaataaggtattcaatatcgacgaaattaaattaggaatcttttgggaaaaaggccctttctagaggttgtcaatttacgaattagtgatccaactgggcatcttacatatgaattcgtgctccaagtatggtagtaaccctgtctccataaaataaaggaagaagaagccaagactaagagcttgctgtcagcttctagtctctattcctatccgagtccctttttcagggataacctacctcttccgtggtacccacctccaaacaactcctaattcccctaagtcaatctgtcaatctcgagacaattctcgcctaactcagtgtactttttagccgggaattcgcccgagagcaccttctactgcatccagtactggataggatgacacccaacataccagaaacggatgatctgattccattcaattggcttagattcaatagcagttgattttgggcaggaatctgcaggtactttttctaagtaagagattttgcattttttgcaaacaagtctttagaataccttttcctttgtacagctttccttgctcgaatatgaggaaaggagagattgaagtagctaaagctaaggctttctgctattcaaccttgtaagcaatgtagagttcgtaaggactagtaagaaaggaatgccattgattccgttggaggactgcgttttgcgccctttctttatctattttatcactttcattctggaggacattttaatttccatccaccagctctatcgctttagatattatctactataagagttggaaagccttggctaagaagaattgaagttttgcacatatccgcgggttcttcaatttgctttctccctcatagaggaaataggtatactatattcatccgcttattgggactccttcgtttgacctatgcattctgttatcatttccagttggacaacccatgtttacaatttgaggaagaaacgaactctttccatttcatttttttttaggaaagcaagtcccttcacttctttaggggcttggagcagatgaagccttcttcggtccgctttggctcctgatcttgagctcgctggcctcagacctggcttcttcttatgatgtagttgtataggaaccagccactacactagagattttaacataaatggactttccctgggatttatttactaaagggtagttctttgagtcagtggatgttacaacgcatcaatcagattctgacctgaaaagaaatgtgatcctcgaagcaatgaaagagcatcagtcccatcgccgacttttatttccccttaatcccgttctttgattcagatttggaaaggggaattgcaactgaaagattcgctcatgcatttccttcaggcaggaatagtgagttagtcaatgccacacaactctttgaatttgctgcaaggacaggggcaagggagtcgaagaaagcaaataggttctctatcgcaactctgctctttactttagataaagaggattctgcgcggaaagacagatcagcttctcaacgttctcttccagctatcaaggagacgaaaagctatgtgaagtcaaatcaacgttcaaagtcatgtgtgattagggaatgaatgtagagtgagaaagtttcgctaaggcgccgtctaacttgagctctctccctatgtatggtcgatatcttccctctgaaaatgctgttcgggcgtcaagtgggaattctctttcaagtcaagttcacttaccgcttccactctctcttctctcttctgtcgatgcagctcactccggggcaagtcaacggatagatggcctgctttctcactttcatttggcttattcgatactgctgaaaggaacgaaccgaacctgacctgcaccttattttcctaagcaaactcccattgactggcgagttatttttataccatttagctcgcttggcctccaaaaaagggaattggaaagaaatctcttatctcttatctccctagttctacctttcttatcatttgcagagagctagcttattagcaaagaaaagtcacgggagatagaagatagaacaatgattgaaatgatcagccaaagagagacctcctgagctgttgcaagtctaaatacatatccaatagtttcttcagagagagtacaaaaaatccaggactttcagagttgatcggtgccaggcatcatagtctgggaatctcctcttctgcatggctaaaggtgaggttgctgtatttggtccaccagaatttactggccgatttaagcctagtggaaagggagggatatataaataatccaatggttccttctcttagcgtcagtgaaccaagttcagtgatctaatcagccacgaaaagtaagaaaaaaggaacttttgagctcgtcaaccacttcggtgaaggaatgggaatagacccgatctagttgttgttacagtgttccctcttagatggagcctcaacagcagctaggtctagagggaagttgtgagcattacgttcatgcataacttctataccaaagttagcacggttaataatatcagcccaagtattaataacacgcccttgactatcaactactgattggttgaaatttaaaccatttaggttgaaagccatagtgctaatacctaaagcagtaaaccaaatacctactaccggccaagccgctaagaagaaatgtaaagaacgagaattgttgaaacggaagatcaatcggccaaaataaccatgagcagctacaatgttgtaagtttattcttcttgaccgaatctgtaaccttcattagcagattcattttctatggtttccctgatcaaactagaagttaccaaggaacccatgtatagcactaaatagggagccgccgaatacaccagctacacctaacatgtgaaatgggtgcataagaatgttgtgctcagcctggaataatcattagaagcacgtaccggacacctcacctattgtcgtctactggcggccatttgtcataaaaataaaagaaagagcacgccgtaagcgcacgaaactatgagctcctaactactgtgtaatcaatatctccttacccccatgcatactaaaactaaaagaataggacaaggaagtgacatataatactaatataagagaaagctggtattcaattagctagagagggagacagggctaaggcagatgccagtctaatcttccttagaatggcttgtgcaattgaagcttggtttaataatagtataagtaagatggcatagaatgtgctgttgtcgcatgaataggaataggttgttcaagaagtggttgcatatagttgaagggggcttgtatgaagaagaaaaggaagaaggagctgttgagtcagatgtggcattagactgttttcaaataggttcttctcgaagtggtcattagtaagccaaggaactgattgacccaaggcaaagagtccgttcatggtataagtcctttcgacaaagaatgccgactttcctaaaacgattggaactaggggaaggggagaaggcagaaggtaagagaaaagggaaaggggagagtggtcaaaagcggcagactgtaaatctgttgaagtttttctacgtaggttcgaatcctgcctctcccacttgttgtagactgaagagaagagaaaggaggcattcgtcagcgtaggaaggcccaccgagcgaagctctttcttttttttggccgtgccgaaaatttgatcgtatgttagttagagaggttggcgaactactacgatcaatagattccccatctatatccaatcccaacggggaatagaagcgagtcgcttccggctggcttatagtcctagtcttttagcttatgtaatggtcggccttcctacacgcacgcgcccgccggaatgcctccttgttttagttttggacgaagccaagccgatacatacaatatacgataggcgaaggaaagacccccatttattgaatagcgcctgggcaagtttgatcgaggattggagaggtactttagtaactcgactgaagggagaagtgggaagaaaaggctcgggatggatttaggagtctttgtgcgagccgtatgcggtgagagtcgcacgtacggtaacgaggggggttcgcgtctatacgtgtagtgtggtggttgggcctacccaccctatttgttccatgatctatgggtctactggagctacccacttcgatcaattagccaagattttgaccggatacgaaatcactggtgctcgatctagtggtatttttatggggattctgtctatcgctgtaggattcctattcaagatcactgcagttccttttcgggcggctgtaggacggacggccgcctataggtggtagggtagggtgggtggtaccgctcagattgcggccaatcttcctaaccgcgcgcgggccgggcttagagcgagtgaaactcatcactacctcgtaagggcattgagaccatagcatgttacacgaggaaaaaaaacccttgtagtgttgtcacacagctgcccgcctagaagagtcactcgctctgtagtgttgtcacacaagataagcacgtcgcccgcctgctggccgggcgaatcgaagttctcttccggtcaactgtccacccagtcaagtgcaaaaaacacagtagaatcacgcaacgcacgctactggtgtgcttcctgcccgcgaggaaagaaagaagagcgacaaggttgagttcagatttgactgtttgcagcatgggagcagattacccaaaaaatccctgggaacaatgaaaaaaaaagatatctcggtaacaaaaaccatagggggctgtattggcgagatccaacggtgaacagctgcccaaaataaaaaccgcctggaagtccgaggacctttagtaccgtacccccaaaccagcagccttcgcgccaagcaagaccgcccttgtccctctcctttcagtcgagtttgtgttcacaacctctctagacaagtgctcgagtgacttcgcccctctccttttcagtcgagttgctaaagcacctctcgcaataagctcgagttcctcttttataagagtaataaatacctgcagacctttcctttctccattccgcctcattcattgttttattccgcaaagcaaaagtggttcgtatgcctactttacctacttgacgaaagggaacgcactttgttgagtttccgggtttttttatagattggattcagtcagcgtcacgacataatcaaaaggaaggagtgaggctttggttactggcgaacgcttccaaaggcgaccttctcgagtttccggctgtttcctagattgaaggaagtagccctttcgtcgccctaccaaacgcaagaagtcactatcaaacagctcgccctactgtgacaaaggtgcgctccgcccggtgactaagaaagaggtttgcgcaacaattgaagtgatgaggtcgagggaagtagggctcctattgactaaagattggttcttcgctttcctttagaatgaaagtagctatgaagcccctacctacaacttactttgtttgattcaaaaggcgaacagcccccccaactagttgtatggggtggggttcttgtggtaagctgccttggatatgagaaattcctaaaaaaaggcaaagtccgctattagacgaagatcttcctatcaatagataggaattagtgttcgatataggggataggatctatctgctctctctaaaaaaaaattgagagagcagatataacgatataaaatcggaaggatagatagacatctaaagaaagggatgtctattctattcctctttttttatagaaagaaaagatatctcgttcatctatcttttgtttatttatcattgattctatctatgaatcaagtcgaattcgtttttggccgaagccccgaatggattggatcgtttcccgccaatgaaatgaacgcggagcccgttccgaatgcttcttcaatccggaagttctcgcgaagagaataagatgctgctccccctccctctgtcttttttcgctttgctaatcttccccttcccctctaacgggggccaggcggcggcgggcgcgggaggaaaaaacctaagagaagacgctcttaggtccttcttttttcagtgcaacataggaaagcgccctctttttgtcatttctgcagctttccagatttggtattgaacgcatggcgtagctaggaccttaaaattatgtttgagcctatgttcaaacaaaacccatcccccggctggaaagaatgcccgccaagttttgataaggaaggaacaaccccggaaaggctcgacgaagggagggagatgcggcggggtaaggaaaaggctttcggagatcgagagatttcctttcttttgcatcgaaaacgaagaaggccgaggatagcctacggtgcgtgttatctgaagggagcacgctttttcgaccgcggtgctatgattgccggagcctctcctcgttccgcccgctggcctattgggatagcagcctgcggcctttgcctgcccattagaataataatcaaaaattccggctcggcccgggaaagcgctggcaacaacagaaaggaaggggtccatgtagctgctgcgcccgcccctcttcttagtcaatggggcagcaggttcggcatctactagaaaagagagaatccacttcagaaaccacacctcggctaggcagcgtgtggaatggccgagagcggacctttttggatatataatccaagtcgagagtggagttacaggaacagccgtctgatggaaaaaaactttcacgttcggttcagagagcacttttttcgttgagaattcctcgttccctttcgtgtgaattccccagtggcgaatttcaaacttgtgggtctattcaatctctcgagccccgaagaaaaccccctccccctcggactccatattccctttgactctatatatgtgggcaccagatatctatgagggttcacccaccccggttacagcattcctttctattgcgcctaaaatctctatttctgctaatattttacgtgtttctatttatggttcctatggagctacattgcaacaaatcttctttttctgcagcattgcttctatgatcttaggagcactggccgccatggcccaaacgaaagtcaaaagacctctagctcatagttcaattggacatgtaggttatattcgtactggtttctcatgtggaaccatagaaggaattcaatcactactaattggtatctttatttatgcattaatgacgatggatgcattcgccatagtttcagcattacggcaaacccgtgtcaaatatatagcggatttgggcgctctagccaaaacgaatcctatttcggctattaccttctccattactatgttctcatacgcaggaatacccccgttagccggcttttgtagcaaattctatttgttcttcgccgctttgggttgtggggcttactttctagccccagtgggagtagtgactagcgttataggtcgttgggcggccggaaggttgccacgaataagtaagtttggaggaccgaaggcagttctccgtgcaccggacacgtagcttaccgaatcagttgcgacaccgatgggaatgcatgctacgaaagatagggtcgagtctgatacatcaaccgtctactcaatatccttagtagagtccacaatcactacacgagatgaaccttggtttggtgaattgaagttcgccttaggtgtaataggactcccagttactgcgcgcgatcgtatactgagatgctccccgccggttgttggaacgacacgagccgggacgggcctagattcagaaagatgaagggccccaaagtagaaatagggggttacaaattccccatctcattgggggcggaaaacgaatcgacatctcgatgtgatacagccttttcttttttagttgggaaagaacggcgaagtccatccgaaccgaaccgtccaatgaagaataagaggagagcaaagcgccaatggcgcgcgaagcgcatgcggagcaggcacggagaaaaatcagtgtggaggagaagcagccgagctcattcccttcgcatcctgggcccaaagcagtgcagtctttcctggccaaatcaaggatttggggcttcttgctacgatacttaactatataaatcctttagtaatatataaatggaaagatagatccatccatctatcctatccgatttccattttgatatctaaaaaagaatcgatttcattcaacgtttgattcaaagaactgcgcctagcccccccgctcatgaaacggctctgctgtaatggatggcagagggtccgtagtacccaaagcactggagtgatccagtagccgggaaggggcctagaagtgcctactactactacaccatactacacttggctctacacatttaccgagctaacccctgtccagtgcctggcagagctaagggggcttcaatccttattccttatccccatcttcgcccaggctaacggggccttacttattcagggggggagcctcgagaagcactgttgagaagaagatcctaggcccctcttcattctctacagggtttctttcttcaatataggtgacaacgagcgaggcagagatggaagagatcaaagacgagaataagaagccagtaaacttcctttttgatcattttgtttgatagagggggatagaaaaaatggacaaaactgactcgcatttctcatcgaacaaatacgaaaaaagaatcatattgaaaacctcacctctcctctcgtttcactctcgttcctttccttacagtcgagctcctttgttcctatggacctctcgcaacaagtgctcgagtcatgacttcgccctctccttttcagtcgagatcttttaaccttttagtcgagtgcctttggccctctcccaaggataaggtctcattaattagttgatgaggggtcgagttactgcgttcctaacctaaccccttccttctccgagctttgtatcataagtgatccgaacctgcccggagtgagcctcccatagaggcaagttggtgagccgtatgatgggcaactatctcctgcggtttggagaggactcagctgttagttagtatccccttggtttcggggtggaccctttttcactctattttattatatacgcttagtgaaaagaatgttttttgatacacctaggacatggattctatatgaaccaatggatcgtaataagtcgttactactagcaatgacttcctttttcattacttcatccttgctatacccctctcctttgttctcagttactcatcaaatggcactcagttcatatctttaagttcgatcattgacaaggttcaaagaaagggtaggccgtcggtttgaatccaatattatgcactttttttttttcaaaaatacggaattcacaactagaaagggaaaggtttccgccccccgccatcaacggtaatcaattcttaaagagtaagctcaccgctttctcgctcactctttcttctttccctttgtggctgacctcgcttgacggaagcctgcttatttagcgacacaacaaaagaaagcacctgttggttggtttcacgattgtcgaaggcggcgtaacaactctttcttcccttttgtcagctcaattctttttttttatagactatatctatagcctcacactcgccagctgagttcgttggctagttttgatcaccccgaattcgatttctcatgcgagacagaggtagacaagataaaggtcaatcgcgggttaactacttatttgattagaaagaccaggctattccgctcgctctcaggagcttgagtagaccgttcgttcaactcgcctgaaggagactagacttccttaaaaagaaaaactcgcttcgctcccttcgcactcgtttaccgcttgctcttcttattcatgattataccgttcgcaggcattcctggtcaaactgactggcttggggcctgggggggaagaatattagttcaatagccaaagcggaccagagaaggttagtttagtgacccgcagaaatagaccaaagaaagaccgaggcaagaaaaaaagggaaagtccggcttgattggctaaggggcataggtaaggaaaagctcttcaagagtggtcttcgaacgaagggagtataggagttcgatctgttgtcttagaaaggtggatagggacctattaagtattactttttgattactttttgtttagtgcccgagaggtgctttagcaaaccgaccgaaaaaaagtaactaagctcactccctcaaggctttgctttcttcctggagcttaagttgtattggaaaaattcggttaagctcttctggctgaagccgacctacttgcccctttttctagctttttcattatgctggttcaactactgcttatgctggaaatctctcaacaccgtcaatccactctcaatagatgctgcccagtatgaaaaggtgataagtagaactaggggaagaatcttctttggctcggtaatggaatcaaaagtttgcccgaatagggatataggaagaagccaataggctacagggttgccagcagacttgcttgacctattgcaatgccagtataaacttctggcacgtggtcggctagctaaagatcagtttcggttctaggcaaagatccgccaatagcagtgactttcccagttcccattctttattgtccagtcatccttgataaacagctgttggtacaactgtcatcggtaaaggggcttgttgcctccgataccttatcttcctgtatatgacctgtgcctaaagcacattgccaataaactgttctagagcgagcaatatccacacactcccatagaaggccaaacttaaagacctgttggtcgaaagtcgaacgcttccaagagtgggcacatatctcaatctcaaagaactttgaaagagaaggatctccatcaatgaaaagaaggtagtatgaacggatgtgctgtaaccaggattccacccagttacgatagaaagtatactcattcatagctgcctccccttcaaagacgacatcctgaggaggcaattgaagtcgtttaggcttcaattttctcttcagcatctcaactagaattccctttatgtatggagagaggggactttgtctccagcaatccaccactctaaaggtagttgagacgatgacgggggtttagaatatattgtcctcaatctagtccatttcttggacacatttgattgaaggtttgccctcacccggaaaccagcacctgaaaggcgcgccacagtattcaaagaacaattgtaacgcactcatagtgcacagattccaagtgaagaccgaaaagttaatagtgcctttaaagagattggagacaaatccttttgaagcgatttgctcgtacggggcaagacccatactaagagaggggagggaacgtggtaaggtccaagtaatcccgtatgatttcttagctatagtaagcatttcaattcaaagaaggaatcactaagcacagatttcttctaaagttcctaggggtttctctcacagctaaacattctggctttgttgtaagtgctttcccgaaggaatcactaagctcatctttctgtgctgattcccaaagagatctatttattagggaacaacaactgaaacttatgtctacaagaaaccttgtgtgcttgctgaactcattaacttgcttagttcgggaagacagacttccattaacttgtttagttacctcccggggaagacttccttctttaacgtcagaagtgtctcgccagttcccgttgacaactcttccttctgatcccaaggaatgcgcgtctggtggtatcatcgtatataagatcacggctgcatttaggattaactcagttctcggcatcaagaccgacaaagagcctattggacctagaaagaaagtagcagaaggggcgtagcgggcaactatgggttctcggggctattcctagtgtaagtttattaataagaaagtaagtcttcagttatagtcttcatggaaatagtagtatatgccgcaaatggtctgctaaagctaatgtccgaaaatcctctgctcatcgaaatcgaagaggggcattcaaatagtgaaagtgaatctatctcactagctcaagtcccactgctcttattccgctaatgccgggagagcgtctaaaaggatatccctctggaattgcaattggagaaaaggggctttgggacattctccccgtagatgctgagaatcttgcaaagaaagagcctagttgtactaccagcagcctaattaccatctccgttctatcaaaggcatgaagtgaaggaggttactgcggttattccgccggccaacaagcccaaggtgagacagccctgctaactcgtactcttcttttaatgccctaggatcggattcaatagtagctgagtcatgaaaagcaaaagcaaagacccctccgctagattcaacttcccctgagcttgacctgcacacacttgcacttttttcgcccggcggattatagtttcggggattattattgtcttctgtctggctgctgtgatcagctctacaatccaagacccctcagagtatttctgttttatcaattcgtttttttactttatccattaaagaaagaggatcggttacttgtctctttacttttttttgatagttcccaggttgatagactattagtttagttttaggctcacataccctacttgattgagacccccgaggaactggatcgactctaaagtaagtagctgtacttgcctttttcttagagtagattgaggaagaagtggacgtagtcttgctgcatcccctgaaggagaaggggctggctaacctatctttaaaataagctggatcatctggagttcttatcaagaagtctgttggtacaaatgtcatctgagatgtgaaagcgatttgactagttgactaatcagtagagccgactgtagcatcgaaagagtcagtgctggggaaggaacgaatcgaatgtatgttctgtaacaagaaggttcattcttctttttcaagagcaagcccataaggactctgtagatcgcgagaatgcatgttctgatgttgcacgggtaagaggctcatctgcttacttaaagtgagtttcacagaagggaggagtttagcaagaaggatgactctcgattcaatcattagtgggattacggcagttagtcttagaatggttttcgcaattgagtcagaagcatcggctttgaggaagaggctagatactttatacatattgcgtgggacaccttaaactggacactctctatcagtggagaagagagttgataacacagtcttgtggcatcaaaggcttgggcacatgagccagaagaacatggatctcttagtaaaaagaggattccttgacagaaagaaagtgtcaaccttcagcatctttgaagattgcatatacggcagagctaagagagttagttttgatttagctcaacatgatacaaaggaagaaaagctggattatgttcattcagacctatggggagctcctacagttcctctctcattgtgagtacaaagtttgactaatttgctcagttggactgaaagggtaccggaaggaagaatgacagctaaacaacttttagttcccaaagaagatgagttgggtgggagtgtgctgcacaagccagctccaaacaaaactctagatcttctggattcaagtgattcttttccacttgggtgacgacgttttacttagtagtgtatggaatctccaaaaggagtgtgctcaagagcaagcaggaaggagtatgcagcacaccttcgaagtgaggctgctaagcaagtgaagagaacaggtgaacaggtgaagagcacagaccttgagtcttttgattagtgaaatgataagggtacccgagtttcaatttatactacggaaatcctatcgggcatacgaccagaaagtaagaagcaggtcttcctggtgaggcagcttttcagcccgaaacttcttcagctctagcgaagcaacctccttctatagtttatttctggctggcctgtcggagtcctattattgtagatgacaaggagctatataatccctcttcttttccaagaacaacgacatgctcttagatctggaaggctagaagagagagtatcaacttgggtttgcggatgccagcttggctccgaatcgttatggagtgacgatgttgtgccggataaccgagaaagggacaaggtgttgttctaggtgtgtgcattgtgctaagggattgggaatactcgctctcttctgtgtgctgatgacagtgaatgcagatgaagatgaatctgaggattcgttaggcatgattcgttgcatggtcagggataacagaagaaagtgacacagagtctgattcatcaggtcgatgtcgaaggcaaagatgttgaaaaggaggacagggctatgtgtgaaaccctaaagagaattttattctggaaaatgagaacacagcacagagctacgaagtcttatagagaagctaaagacagacatcgaaatcagctaagcttcagacagacctagacacgcagctcaagctgataaggatgctgaactcaggaacaaaagaactagacaagattctgaacagtcaaataagaagagtgagaaagtaaggtctaggatatcaaggcgtctcaaatacggaatgtattcgtcaaaggaaagcagaaggagcaagcatacgtatcagaaagaaaagaaggccacgctgtaattactgattcttactgctacgactattttgacagattggatgcgctctacggttgacgtaatcaagcatggatcaaaaggacagatctatatggggctcacagcagtgtgctaaacacctacagacggagatacaacagagatgcagaaaacctgattacagaactcaagctgtagtgaagtctgagtgcgcgagtgatttttcgagatgaaggagaactcaaatgcatgtgacaggagtgtgctaagatgagagtattccctgtttgatagtggcttttccagacattgttgggaaatttacccaatattctttcgtgtgatgaagatgggaattagacaataggaatgcaagaaaactctttttatattaggaaagggaatcgacaacacctaggtcgtctgaccagttctcctccactttgttgagatctttcagaacttctcggatccaacgatgtcgtatatcgattgagcgggagtgcaaggtcgaattctttgctaagtgaatagcgctctggttatcacatagatatatttatcttgctttactcccaactcaagcaagaagttcttcatccacaacatctccttgcaagcttctgtggcagcaattctgcttcagtcgtggacaaagctgtagttttgattgccaggaaacagctcctcctgcaaaggtagttatataccctgaagtttatttcctagaatctttgtcgtcggcagcacaccacatcggtatagcccatcagctcaagcttctcattaccaaagcatagacaacttttacgtaaatagtggaggatccatttgcagtctggattggctagaaagcgactcacaactgcataggcgatatctggccttgtacacaccacggcatacagaagactgcctactgcagatgcatatggggtagtcttcatttcctccttctcatttgttggactttgttccgagcttaattttaaatgtccagcaagtaggctttgccttgtgtatattgaatctctccacccaacagatcgttcttaggataacaggtttctcgatctatcacgagtgatcttcatcccaatgttttgctggccccactttcatggcaaagcacttgttcaaatctttctttagagcggttatcttggtgcggtcatggcccacaatcaatcatcgacatatagcaaaagtatgagaaagtcgccgctaacgtacctctttatgaaggcacaatggtcattcatggttttcttgaagtatccaagtagcgctaaaactaaaaagcgaactattggaattcttgggcttagcctttgaattgacctggatcagtcctatactaggtcacaatcaacccataacttaaaagaaaaagatcgaagtcgagaagttcatcgctcatgctttcaaccaaccccggaaagactccgctgacacacacaatatcttcgccaccctcccgactcgcgatccccaatgtggctttctttcctcacttcggtaagttacaaggatgaatgcaaatagcaaggcgctatgctgcgtgaagtgagaccggctgtcctaagttaagtgcttccttattcattaatgatcttgctcagtaggagggcttttccccttctgtgcagcctgattttatctctggaaatgagggtgccctcgattgaaatttttcatcgaatatgattgaatccccccatgggtgagaaggttgagttacagattccgttggctttcgcaagaaagcatctcgaaagttccgaaatctatggttgatgtctcactcgaactctatccctgactttcttcgtccgagcggcccctctagggcgcgatgcgagaaggaataagtattttttataccattaaataattcgcaatagttaaccaagcagtagccaagaacatagaagcaagccaagatcaatggggggtcgccccagtcaaaaatggtaagaaggagtagcatcaataacattcattgtatgtacgcctcccagcgatccacaggcatctgtagcatgttgtacccgagagttattttggctgtgtccgttacaccatggacaataatcttagtcggagtaaaattccttacctttccacccaaagctgaacatatccgcacagatattccattttttttattgaggatccattttcgaactgaactactcatgcctaggcaaaacaagcaagggagttcttaataaggagctctagctacagctccctgcgggagggttcccgtgcttactttactaaggagcaaggcagctacgcaacacttccttgcaactcatacctactaacaaactgtttactctttttaaggagttagctgcatttccctgcgggaggtagctacgcaatcaaagcagcagggcagcttcgcaacacctgcttcaactttttgcacattagcaacaagattggatagttgattgttgagaagatagctgcagctcccggaggaaggaagtgaactacagttccagggggagcacagcaagggccaataccggctgtgaggcgcgtagcgggaagagatgtatggtaaaggatagctgtttaaccatttgtaatggaatgggatgttgatcctccttggaataatacgtatataatcagattatcattccagttagagatatcaattaagaaaacactgccaaaatacgcttcgccatgtgcggatcaagtccttttaaggcgatcccgcgaagcaggtctacggtgtccacgattgtatccgactattgagtgaggccaacttcccgattgatagaatcttacgccccaaattcccatctcttttttcttggttggaccaaccggcaccagccatttccgtcttccttaattgggagagtcagaatcagtctctctttgtttggggggagcagaaaatgaaggaacctttgctttgaaaatgattgttctaaaatggttattcctcacaatttctccttgtgatgcagcggaaccatggcaattaggatctcaagacgcagctacacctataatgcaaggaataatagacttacatcacgatatctttttcttcctcattcttattttggttttcgtattatggatcttggttcgcgctttatggcatttccactataaaaaaaatgcaatcccgcaaagaattgttcatggaactactatcgagattcttcggaccatttttccttgtttcatttcgatattcattgttgaaccatcctttgctttggcccttgacgacgcggcggaggctctcttccccaacacagccccgaccccttccaacacctcctcgtcggaggattcttttgggctgagtgttctttcggaaccctggcccattacccgaaatctcgggttggagtcttcgatttgtaatcgaattcgcctgctcgaggcggcgaattccccttttctgcttggaaaagagaaagggcagtattggggggaaattcaagaatgtctttataatgtttccgaacaaagggagtattatagactcttggatttcgagaaccgggatctccaaataagggaacggaagcactcctgtttagaagtctttcggggagtgcttttgaggaatccttatttggaagaaagggccgcctactctcctcaagaggcttttttcgacttcttgaacgagaggcgggacgcgctggacatttcgaaccccggatctagcccggccgaaatggaccgcctagagatcttatttctaggcgaaatagagcgtgaccttctcagacggggcgacgaatctctttatattaaacaattacttggggattgagatagttcgcggagaaggggaaggggtgctttatttcgggagtaaagtgatagggggttcgttccattgagaatagatggaatattgcaccatcttcaactcttctcggtatcgggagtttttcgagaaaaggtcccatccttcaatatcatgattgggtcgaccaggccagatcatgagtaaataaaaaatcgaaaacgtacatagctgttccagctgaaatacttggaataattctaccacttctactaggagtagcctttttagtgctagctgaacgtaaagtaatggcttttgtgcaacgtagaaagggtcctgatgtagtgggatcgttcggattgttacaacctctagcagatggttcgaaattgattctaaaagaacctatttcaccaagtagtgctaattttttcctttttagaatggctccagtggctacatttatgttaagtctggtcgctcgggccgttgtaccttttgattatggtatggtattgtcagatccgaacatagggctactttatttgtttgccatatcttcgctaggtgtttatggaattattatagcgggtcggtctagtaattagggggcggccgttcggtcgcctatgagactaggaccaataggtcaaaaattggtttgtgccgcaggtgttgaatgatctactctacacaggtgtgggcttacagggctagggctcagaaaccctttctttcattcatcaagagggctagacgcgcctttcgaaccagtctttataaacctggtcgctcacttttccgggccgggatcaataagtagaagtcataaaaagatatgtttctcttcgcaccactgatagactactaaagattcaatttgaaaggccatacttagtttcgcaagcctttgtcattgtcagtcaactaagtaggtcgttccgccccctgcgaatccgtaaattgaggagcatgccgcaacaaaaggatggtcccctatgcatttcattctttctagaaaggaaaattataagtacccccatcatggtgaacctctccttgtgatcgggatgaggtaaatgcctccttttcggggggcggatcgaatcgcagtttccttaggtagccaccgacctacagttatccttaaacttccgtgcttggtggagaagaagcgaacaaaggtacgctcgcttgctgtcttgttctctgccgcgaactgggatcgctcgccagctaggtcagattgaagcaacattttttgagaacatattacccatcttcggggacaaggggcggaacgacctctcgatctacttacagcagcccaggaataaaaacgtcgtctaggcgttccctcttgctccgatctaccctacgcctaggacgttgtctgggccaagagtcatagttagttgctgtttccatttggttgtttttttctcgttgttgataccggcaagacccagccagatgatgtctgctggttggtagtgagaggactcttagtatcggcatactcaaaaggaggcgctaattaaaaaacaagaattttattttatttcttgctctcccttagcagcgggaaaggagtctatctatctgcctagctttggtagatttcccccaacgcaattcacagaaattccacgaatcccttggtggataagtccgacgactcagcagcagtgcggaattgagtttctcgtctggtggatctgatctatagttatggggcaatacataccaaaaggttcgaagaaagagtcgttaagccgagaaagctaaaaatttgccttctcatcaaaaataaagaagggagttttcaaggtgttaagaatcgattgaagcatccctggacttctattcgatagagtgatcgaatcgggcgctatggacttaaaagcctcgagggttgtagggcacaagggaatcttgaatcaattccctcttttccagtatttagacaagcggtttgagtcaagtgccagttacagaactaattgttggcaagagtcacaaataagaagtaaacgacttgatctcttctggaaagtgactttgaccaaatagagtctccttccgtatagggggctctcgtagcgcttagtgtagtaagggccttctgcttttttttgctttcattagcctgagagggcatattaagaatgcttatacagggcaactatagggattatagagaatgagaggggctcacttgaccagagtgccgagcattgttcgtcgtgctagttccactactccagttccagtgtgatctacgcctgttagactgccgggctgtaatggattggactatgtgaatacttctttctagggaaagaaggatatcgtatcgggttggacccgctctcttcaggtgtttgcaattcctgtgggaaccgcaccacttgaagcctttgtatccacataatgagaagccctcttttagtaaagcttctcttcatcggcgactttcgcgaatgccttctatcgacaaagaatcccccctgagttagcagcctgccccacttatctagccggtgtttgctaggtttattgagctacctcactactgctttcactggaagcggcttagcttgtgttatgcgtaagacatctagattggcttggcagggtaagagctgcccttgactctctcagttaggagaatgtcattttgctaggaagacgatctttagcagaggcttttcgaccagttactgtccgagctgggatcgttgtattgttcttcaaaccactcttcagtgacgtagtctttacctgcacccttgtgcttcataacatctgaaccatcgtctaactctaacttataatcctttggtgctaagaagatttctttcttgactcgcgactctcgaccttactttgttccacctacacagtaccgaccctgcccttcttactcagcagttagctgctggtttattttcaacgtaggtcggtaacagatttgaattcccaagattcggcaggcttagctacctcttccagtgaagcttctgttccagttgtctctgcagatctgaatgaaagaggtgaggtcaactcatccaatagaggtgcctcagatggctaaatggattatatgaatgcctattccgccggtcggaatgcccggactgaggaagatgtgtacgaggagcaaaaacgagattcctagccttccctccctttgaagtgcatttatcagatcagctcccagagtaactagaaagagggtgaaaggcccaacttcttcattcatggccttttttgtttctttggattgatctccctttcgtattcattcgacctgaggcgttcctctcagtcatacaaaaaagaaaggttctttcatgcaatgcataacgggtgggcctcctatggattcctctaactcaatgaatgaagggaggagtatgaggaaggccggctttctggatgaaaatgaaaacaaaaaggaaaagggtcaaaccatatcttacttaataatctgactgaatgacgaagagctctttatgtggtctcactttaccaccatctgaaatgcgcgaaacttcgattggtggaagccagtccatgaagattctcccttttcctacgtgcacttcccctcttttggtaagcatccagtatctcagcaaatgaacatttctctaagcttatcctatagcttatacgtcgtttgaaagctgcttcaaggatccaacgaatagctaaggtttgttgacgatccctggctacaatcccagggacatcataaatagtacccgctactcctacttttgctacttcgcatatgggctttatattctctacggcgtcaaccataagtttgattacatcgcgttcagttcgagctgggcgatgaaaagtttgataaacaatagcacgaactctcgttcttttaccttctttcatgcgaaaattgaccaacttcttgatcaatagtttttgctcaccatccaagccccccatatagctgaaaatttccgagcaattggaagccgctttcgatgacgaggccgataaatttatattacgcaatcgttactgtccatctttatcagccaactccccagtttctatctttccttttagagtttaccactcttcatagcttcttgaactttctttagggtcttgctccctgagttccagagtctacactctcgcgtcatatggctccgccccggaatcattttatacctcttcttttagtcgagtttgtttcacaacctctcccaacaagtggtcaagttcctttgtacctttcctttgaccaaggggtcctcgaaccaacctgtcctccctcaatctccaagaattaccctcccacgctaaaaaaaagtagcatttcctggacgtaggtagagtcaaactcttctaaatatatagactggattccatttagatataagtcatcatatatatatatatatgagttcagacatatctgaatcgtccacgaggacgaaattgactatatccatcatagaagaaagtggatttggggggggggggagaataagattttccctttcaaaaatggaaaggattctgtcgtagatctcctcgaacaatctatcgaactcgaggtcctcctcaattgtaggagtttcaacaaataaaaagtctttcaattctgcttctgcaaaagtcggagaatcaggggcccctgattcttcttcttcgctagcccctggctccttcttggtgaactgccccttcttgggccgttaggtataccttccttcaaatcgaagtcactaacgcatttttattcctccgcttgaacagagcttctattatggctaaagaaagaataaagtccaatcgaagtggtaatcgcacattttcttccacttatttttatccatcgcctgtcaaccattcattcctttgattgacataggtcgcgagcgatctaattcaaaggagaatgctttggtagaatttattttgtgtgaaatccgcaattatcttcttctccccacttaggataaacttataatatcaatttactagtaagcaatgaacactaacttaaactcgaagcatttgagttgagaaaagaaggttccgttcctacttataagctaagccaatcgatcgatgcaaagtatgttttgagctgtagtgtaggagcactgatctgtacttctggagaagaaaaaaatctgtgataaagacagaaggaatccggtagactgattaagcggcacttgccgtgagatctagttactactgactgagcactaaccaaactgaaactggagcgaagtctctccctattaggtagtagggggctcaaagggaagatgaacttgctaagccaggcggcatataaacctatcggggggataagtggatctcctgttacttttgttcggaagtatgtgatccattaattcaacatcgttttcttggctactttatcgtatgcagccagacttgactcttttaggcaaattacgaagcacatgggcgtccgcgacagtgaatgtgattcaccccatctcattatgtttgagctggtttctgggcaccataggctgctcatcgcctctacctctaaggtgtgctgatctgaggatacttcttctaaagaaaaaggaattctgcctcctcccactgttttaccatctcggcatcttccagcatctcttttatccaatcattccacttttggctttctgtttctatgcccctcgtcttgtttgtccggccgcttcattggaattccagaggaggtatgtcgtctggatcctagctgtttcccgacacattgtcttcttggaaaattcttattatattatgcttcttcacccacaccacttgcaccacccacatcctccatttcttatcttcctttttttgatcttgagaaaacttcgacggaatcggtctgtcaaagcccagcgaataatgcaacgttcgtgccaccgccttctttttgccccagtaggtaatgactcagaactctctgctccttctgcaccatctgtagttcctcttcgacgtttcaatcgtcaatctgtatctactgtctgatatgggtattatcatcttcttttttgactacttttcattctgttcatgtcccttctacctataagcaggcagcagaactcgcatgttggcgcaaagccatagatgatgagctccaggccctagaatcaaatcatacttggtgttcctcaactctcagatagtttgaaatttatcaaaccatgcacttgtttcacaatccatatagagatttacgaagacgacaaacgagagttttttccgcttcctggtagccaggaggaggttgcatagcatataaactgtctccttaagatgaccatgaagaaattcattttgaacgtccatctgatgtaaagacctatagtgaatgggcggaacagccaacggggtacgaacagccaacggggtacgaacagtagtcattttggcaacgggagcaaatctttcttcataatcgatgccatactcctgcttatagccttgagcaagcagacgagctttatacctatctatactaccatcggatttcagcttgattaagtataaccatttgctaccaataatgaaaccactctttttagtgctagattccgccagagttcgcacgactattccatgtttctttgccggagaagatatagagaagacaactagtaacaattacaagtgctcttggccgtaccaactattattattatattccttttcttgtgtctgaccagaagtctttcagtagaacttgtcttcctcttatttgactccaaccgtcgatggcacaattcttctttccgggcaagcaatcgaactcaatcaagtatcggaaaccacactcgccacagcacctggttatggaatagagctctggagttggcttgaaacgagactatttcaaagatccttgtttcggatgatgaatagtcactcgtcagcctgcccttcccctcacagagcggtaacagaactactgggaagatcaaagaagatttcccataacgcgttgacagcagactaagacgcacatctagattggagaagtaagtaggccaatgccatgggtggaaaactatcgcctcacaccctaggaatttggtacgaatcgagaaagaattctctcccggaaggctatgaaatagaataatgagcactcgtcttttttaattctttccgggttcggctaagacggccgctgtagggaactgatgtaccatagcttcgttataccttcttcaaccctatgagaagcatctagatatgtactttccctatgatcactcaatcgtccaagtgctgaggggcacagtgccaggataaaaggaaaagggtggataacgagacccagactttgatgtaatgtaatttcactgccttattgagataggggcatttcaagatgagagagagtgagaagacctgctttcctcctcgtatcgagcatcgctctgagtaaggcttgggaaatcgatatcccggttccgatgtagcattggatcaagtaccaactagtaaggaatccaaggttttcgtacatcaagaggaatctttctatccagtttcgttcatcaagagcttagcaagcatatcagacgcggtagataactcactagggtttgcaagaagcaaatcactctttctttctcaccttcagtagcaatagattgatcttcttttaggattctgcactatcatggaagtgagccgagaaagtaaaggttcgacatcgggtggttgactgggttgccctgaaacagcctcatacttagaaagaatatcggccagatttgagcagctagtgggatccatcttgcagaagaagtgtcatctacaaagaggagatggttgatacgggggctgttgtttgatactctaataccaggcaaacgtccttgttcctgagctcttcgacataatcctgagagcacctccgtacataggataaagaggtatggggaaagtggatctccttgacgaagacctcgagatggggtgactaaaccttgaggggctccattgataatgaataggagatagaagtgacacactccataacccattcaatccattgattatggaagccaaagcaagtcaaaacttatcttagaaagccccattcgatgcgatcgtatgctttgctcatatctgttttcacagccatggaacctctaacagtagctttcgatattcttaagtaatggagtgtctcatgggtgatcagtacattatcagagatcactctacccggaacaaaagcagactgattctctgaaataatcaaaggcagatacggttggaggcgcttcgttaacatctttgctacaatcttgtagtaaacattgcatagagcaataggtcgataatctgagactttcttcggagctctcacttttgggattaaacaaatatgagtttcgttaacccgaggaggaaaggaggccgaggtgaagaattctttgatcttctttgaaatttctggtccaatgatatcccagtatttatggtagaacttggcggaaaacccatcggggcctggagccttatttgaattgagaggactgctgccttaatctcttcatcactaggagaagccgtgagggctgagttcatttcatcagaaatgcaaggagaaagagcttcacggacgagttggaaattacccgaagctctcgccgtgaagatgtcattaaagtatgaggagatgacgttcgctatttgagcttcttgacttcaactccgttttcatcctccaacacagtgaatctgtttatcgttcttcttcctcttgttactgcgtaaaagtatccggtgctcctgtccccaccaacggaactcgacttaaagtagaggaagagatattatataatgatagaagcagcagcccagctagccgatcactcggactcatggccgtctaacgactacaccatcccatgagtcctacgctctctacagggaatcgagaccaaaggggttcctccagatcctacgcttttgtatctttagcatcccacacttcactccacaagggaagattacgattacgtccagccttactagaaagatagaccccgggaacttccaaggccaagacgtagttgatttctcgccttgggtagtgttgccagacgaagacaaggtcgcctttctcatatcttgtcgagttacagcaaaaataaggaagagtggattaccgcaggcttttcaaaacaaatacttcaagagatatcggctaaacgaaaaggggatttgtgctttcctcttaaagtaggggttggaccaagaagataggtcacaagtggccttactctctttgtttcggaatgaggatgggaaggccttccactccaataaatgataggacagcttttggtgccctactctcgcggaatggaaggaaagccacagaatcaagtttgctactagaaaggaaagaaagagagggagacagagaaaggattccactttagctggtagcttcctcgtaaaagggaaaccagagtcaaagggaaacttcctctttatatagcgaggatttgatgaaatcccattttccttcgtaagaggactgtaggaatccaaaacttgctctttatataccgacaaaagtaagaaaccacatttcccttcgtaagaccacatttggaatcaaaaaagccttctccacatggtgaaaagtaagaaaccacatttcccttcgtaagacaaatcttttttggaaaaatgccttctcagcatggtgaaaagtaagcaaatctaggaaatagagctgggtgtgctctacgagaaggcatatgtgttacatcttgagatatttgtttagggcaaacggtcaccgccatttctcgtatgaaaggctggactgtcgcaatcaaactctccgcctgccggatcattcccctgtagctagctttgattaaagagtctctttcttggttcgttgggaatgtgcatgatgagaaaaggtagttagcttatctgccttgttcctttgcttgcatgaagaaagactctcctctgtttgttttgtgggaataggcatgactaagccagttagtttcctacggcgagctcgagcagctttgtattgcgtcgatatctttccatgacatgccccgctatctatgtttactggaaccgggccttaaggtgaagggccgcctctctaagaaaagaagtttgggggaagaagagctcttgcaatggattcctcagtaggaaatgcaaaagaagaaagaaagagcagtgctttcttaatagtcgtgggagtccgggtctaaggatccctttagtcgactaactgacgttccttatatttcataggtagcgcgaagggtgactcttttgggcagttgctaatgttgatgggtttctagttccatggatggataggaactaagctaagtctgctaagtaagcagggatttatactttcttttatcagaagattgcagcgctagttccgaatctgatctcttaccttccgtagttcatcccttttgccaacacagggctacgcttgtttacaacacacccttgtgaagttgctaaattggctatccttttcaggagagttcctttgatctgatcccagcacagaggatagaacacagataagtaagtcaactaggttaggtgaagatgggcagctaatctactaagttggttggttgagcacactcctgggaaggggtaaaccgactcttagggtctttcgcccgcgtttatactatagtggcacccaattgattttagcacgagatagggaccaatcttcatccacgggtgtgtgctggaatgtgtgcaatactagtttatcgggcttgcttcgctaggagtatacagataacagttaggaaggaataacccagcactgcgctagagaaagcagaggaataccgagaagtagagagaacttgcttcgctaggaaaggaaaagggagagttggtttcaccttccctataagaactaaggtttaccaaactccctagccatctatgaaactatgatactttatacttccaaacctgaaaaggaaaaggaagactaaagcatgggactaaagctgaggaggagctagtggaactgtctacccaagaattagaacaaaagctgctcacagtacacctttgtttaactgtacgagcgagaataccagctaatcatgtaactgccaagaataaggattctaaaggaaagagttaggtgtgccagagatcctgggattacctttggagaggaaagctcctactattactattaaggagcactcaaagcttgcttcgctaggacaggacagcacagaagagtagatagcttgcttcgctaggagtgtgctaacttattctcataggcgtacccgcgtagaagaagctaccttcctcaaactcctctgcgcaacccagccataccagagagtgctatcacaaggaaattgtctggtctcagaagatgagagcttcttttttagcagaggtactgatgtcaggagagtgtcgacgcgctcttccccagtcgtgttgaagaagtttgagggaaagatggattctgaaggaaatcggctgacctatcggatgaagcagactgctgcgaaagtggtgccacgagtcgagaactcttagaattgtgctcgttcaggctctttagtgcacctaagtgcgaagctggtgctgcaagggaggatgtgggcgggagagcggtcagtcctctacctctcgctatcgatcccttttgcgtcctttctagctatcgactctatccctttttctttctagctatctcttcttccgtaaggacctttttgttcccccccacgctgatcaacaaccattgagataggatagagccaatgcaggaggtgaccgaagtagctcaataaaagaatgaagaaattgggaatggtaattcgagcaatgaaaagaaagaaagagttcgcccaatcgtatagctttttccttcaaatgcttctatctcacttgtttgctagcttgcaactgctgggcactgaaactcagtcggccgacatcgataagggagattttcttccaaccccttggaagagaggaagagaaaggagtggtgatggcttaaagaaccacgttgcataagccggaagcacagaatgttactcggaaacaagcctgagaacgactcttcaccgttagccattatgtttacctggtcaaatgccgtcgtttatgataggtcggtctagtgagagcaaatgatcaagcaagaacgtgcctacatccgttgatgcacttcgttgactagtgaagggtttttccttggggcccacgttgccactggggtcgctcatcttactctagggtagcactctctatggaaagaagagtggttgtgcttcactactagccaagtccatgcagatggggataagggggttcactgctgtctgatatcatcatatctattttgacctaaaagcttacttgggatatctaagagctaattaaatcttttctcttaaaaaaacgggtaataagaaaacacttattatctttttatttgcaagcaacatctgctcaaaaagaaaaggaagttgacttcacctccggtgaccggcttcgcgggatcgccttacgtataaggacctgatccactctaggcgaagcttttttgggcgaaagctacttactatgttatcttccaattgagttgagagagttttcaatcgaattccaatttttcgttatataagctatttataattgaatgatttaaagattgagtttcaaaaagaaaataccggagaaaaggtgatgcaaacaggaaacctgcttcgcccgttgatggtccaagcccaagtattcattccttaaggagctggacgtattgttcagcttcctatgaagctaggctggcacttaggaagattggacgagtacaagatcgaaaagaaccctataggcaggctaaaagcgctgtccgtcttcatggcctcaataatactcagtattgtactggccgaatccgtttcgcagcacggagtatacctcaatctccgttagttccgtttcggctttttccccaatttcccactccttctgtgaggcaaaacctcaccacactacacttcgacacaagagaagaggaccgggcgcttgtatcttcgggataggagttatcggtcttctttaagaaaactcaaatcaaatactccttatctcatggatcaacttattgctgatttcgtttctaggatgggtttggctctgcctgtacttttattcttgtagccgttaggtctggccaaatgatccatcaaataaatagtattaatatggaaataatcctgactgatgtagcgcgagatgcgcttcaagaaaaaatcgtgtcccaactctcaattctgttgagagtatatagggatactaatactagtgagagtgtgaccttacctttatccggagtaaatctccaagaagtcgccgctcgtagtttttttaacaacgagagcattccatggttttttcatctatttagaccttgtcaatcagggcacgaaaaaaaaccactttgcccacaagctctggagttagtgctttcgttcagttcataaggtagactttttttttctaaagcggtattcctccttgcctctaatcctcaaatctaatatgattactcggctgttcgcccaactggtatcgttatcaattgtaacttattggaatgacgctattgttgcgacaaacttttcctggctcttcataactttctttgttatgactttcacctttcgtaccttctcgcgctacttcaaaaaaccgatcatttggactttctatttttttttatgtttaatagcctttctccttctttgggcagcccgaatccatataaatatccttttctcatttgcttttggagatgtttatagcttcttcatggcaggggtgttcttgttttatggtttcggggaattgctgcccatcggatcagattccgatgttggtgaggcaagttgggtcgtaaaccctgctacaggggcgagcggtagtggggggaacggctggactgagtctgctgcaaatgatccggcaagggaagtttccctcgccccctttcctctgcaacttacacatcccgtgccctttcctgccgaacctggctctccggacccggtttctccccctccccccatagcctcgttctactcccgaatagaaagggctgagtccttacacgccggaaatatagaattggcggaggatctacaacggatccaggaaatggaacgtaacctggagaacgagaggtctccctaccgtgggcgggaactagccgcccgcatcgattgggaggtgcgcgagctggagggaaaagtggcgcgcaatcgcgcctgggatatggtacgagatgctcaactcgacatatggaggcaggggcttgatcaggaattagtaaggcaacaggagaatgagtcccgcctcgaagaaagaaggtttcagtctcattcaaccaactctctttttgaagcagatagttcacgagataattgagtaagttaagatagatgtaacaatttgaaccaaaggcctttttagtgattagtctgctagtttctttgatcttagtcggtgtaaattattccttttttttttctaaagcggtattcctccttgcctcttaattaaaaaatggaattatggaattatctcctagagctgcggaactaacgaatctattcgaaagtcgaattaggaacttttacgcgaattttcaagtggatgagatcggtcgagtggtctcagttggagatgggattgcacaagtttatggattgaacgagattcaagctggggaaatggttctttttgccaacggtgtgaaaggaatggccttgaatcttgagaatgagaatgtcgggattgttgtctttggtggtgataccgctataaaagaaggagatcttgtcaagcgcactggatctattgtggatgttcccgcgggaaaggctatgctagggcgtgtggtcgacgcgatgggagtacctattgatggaaaaggggctctaagcgatcacgagcaaagacgtgtcgaagtgaaagcccctgggattcttgaacgtaaatcagtgcacgagcctatgcaaacagggttaaaagcggtagatagcctggttcctataggccgtggtcaacgagaacttctaatcggggaccgacaaactggaaaaacgactattgctatcgataccatattaaaccaaaagcaaataaactcaagggccacctctgagagtgagacaatgtattgtgtctatgtagcgattggacagaaacgctcgactgtgggacaattaattcaaactcttgaagaagcgaatgctttggaatattccattcttgtagcagccaccgcttcggatcctgctcctctgcaatttttggccccatattccgggtgtgccatgggggaatatttccgcgataatggaatgcacgcattaataatctatgatgatcttagtaaacaggcggtggcatatcgacaaatgtcattattgttacgccgaccaccaggccgtgaggctttcccaggtgatgttttctatttacattcccgtctcttagaaagagcggctaaacgatcggaccagacaggtgcaggtagcttgaccgccttacccgtcattgaaacacaagctggagacgtatcggcctatattcccaccaatgtgatctccattactgatggacaaatctgtttggaaacagagctcttttatcgcggaattagacctgctattaacgtcggcttatctgtcagtcgcgtcgggtctgccgctcagttgaaagctatgaaacaagtatgcggtagttcaaaactggaattggcacaatatcgcgaagtggccgcctttgctcaatttggctcagaccttgatgctgcgactcaggcattactcaatagaggtgcaaggctgacagaagtaccgaaacaaccacaatatgcaccacttccaattgaaaaacaaatactagtcatttatgcagctgtcaatggattctgtgatcgaatgccactagacagaatctctcaatatgagaaagccattccaaatagtgtcaaacctgaattactacaagcccttaaaggtggattaactaacgaaagaaaaatggaaccagatgctttcttaaaagaaagagctttagctttaatttagctttcatcacattaggaatcctcaatcagtaagaaagaaaagttgttaagcaaagactggagaggcccccggtcgagatgtagtaagtaggtctccaatactgggagactgaggagaatgggagtttgtgggttgagggtggcatgctccccagggccctcttttttttagataggtagggtaatgcatttcagtatgaatttgatctagcagtgtaaacctgagattttcaagagttggccttataattacatgtgtacaggtctaggaaccatacaccctagaaagaaagggatatcggtgtgttgcaaagccctacccaagcaaagtaagagttgactatttttcgcccaaggaatacttcactttctcattccagcacactcctgggtaatctgaggaatgtagaagtaagttatgcagcacaagcacaaccctgcttttccattccttcatagcccacctcttcattggccataaagccttgatttccttggaccacgtacactgatgattggtcgggctgggctactctatgggcgtatgcgcctaaaccaggctcaaagcgatgagacttctcggttagactcaaacaatagatcaggtcagtttggaggagctttatttgactcggtctctaagaagaaagggcagccctctgatatatctttcgacttcaccctcggccaaagcacagtaagttagagactcctagtctctactaaataaatctatagcttcaacactctcctagcgcagcaaccttctctctttctcccttacttgcctcccagtcttgagcagcaatcatctttgcttatgcggacgaaagtctttccacagcactccgacagaagtctcatatgatgactctgtttactcaagagccttctttctcgattaaatgcctgcccactaccccaagcaagccgcataggtctttgttagcagctaggcttctgtttctttccataagcgacttctcctgtagatgcccaaaataaagctttcgctcaagggatatcgcttcatttactgcgttagggtggtgccaagcccttcatctctggctaaggctcagtcagataggctcaatatcgggcttatccggcgaagtctcaaactctgttgtgccagggatatcaggcttgagttgggacaggtgcttatttcgataccgcttctgttgtttttgtgatgctggtgatcacatttacagttagaagtaggccatgattgattagctagagtagagctaggttggtgctgctttgcttggcaatccttgatctaattgaatcagaatccgcaagataagcagccaaacgagcagagcagtagaaggacaggtcatctagaatcctattcttccgatgctttgatcggttccttctgatatggaagagttgactacccagcacatctttgtttgctcgactcggtaagtacagccgcttcctttattcttttctttgaaccattaccctcaagggactactccgttggcccagtgacccttggtcttttgttgctgttccccgttccctttatcagctctttaccagctatccgattaccaatgaacaatagctatgaccgataaccaaggttcgtagaaactctataaggagaggcatagaccggtggtcccttccaagtgcctctttgttttgtacgagctgtttccaagtgttttgattagtcgagtcttcttctgagtccagcacttttcctttgtccgatcgtccgtctcttcctctcctcttggtcgagttgctaaagcacctatctttctttgttgcctccggtgtgctaccgagcctttcccaggtatttacttactgccggtttactccacagcattgccatcttctttgttttgttggtatgagctgatcggccctctcaagcgtaaagtagtcctctgattgtgttgtattggctccttaagcaacatttgtttacttatgaccgggtgctgcttatgcctagacatcttccccaggacttattctcgaaagacgttgacctatggtaggtgctgagtccagcacagttgttcctttgttactgtgccatttcgagaccttcgtccgatcattgttcctttgaagacctgtcttttattccttctctttccttgcagtaattaactcacatttatggtaatgctgatgcttggcagcttcactgttccttcttgttgtgcgtaggcttggcgttgtttactccaccgtgctatctttgtgctgctaatcagtatagtatattctttgcatactgctatctttgtgctaatccatttcagtaaacgggaaagtggaggagtaatgattggttccatcaatcttattatttcctttgttttggcttgggtttctttcatacgagtaatgctatttatcaatctttgtgttcatcagtagactcttcagctcctggctcctgatcaatcttccactctgcgcctgctgctgatccatgtcattcagatgttcctcgtcctgttgataaagcacctttgcaccttttcctcgaggttggggttttcggtatgcttacaggggttttagggcggagtatgagcgtgttgtttattcatcggcaccttgaccttgactaatcgacgtaaagcgtcttggcttctcgtacggcttggtgctgtaatctttctttccttggtcagtggattatggttcagtacagatagtgataatgctccaatggttactgcacctgtgtagggaatcttatttctttttctttctttcgtaattaagtccattttatcagtcggggaagggagggagagtcctgcttcggacctgtgacctgcttcggggcataagtgtattagtgcttctgtgtacgattgtgctgatcagtcgttcgtgcttttgcgataatgtgataactaaaataaagaagaatgtgaaagtatgagttttgtacttgagtgatgtgctactgatcagttgtgtgagggcttttgtttccatagagcgtgtgcgaagtgtggagtttcgtacttgactccatcccgtgatcaatgtgctaatcatttcaatattgagactccatcctgcttctgctcctgatcctttgtgctgctaatcagttttgtatgccaaactgctcctttgtgctaatcatcagtagaaagtggaggagtaatgcttggtcaaagtgctgtagatttgtttcggtacgagcactgcctttgtgctaatcatcatttcagtatattctttctttcgtgttccatcctgattaatctgtaatctatgttttgtacagctggcttgggaatcatcagtagagtctttccgctcctgatctgtcaactttctttcgtacggctgcttggcgtgctgtcatctttgctactccgcttcgtacggttttgggtgaaggttcaatcttttgtttcgtacgagtcggatatgtttgtgcgagaagaaggacagctttcgtagagagtccgatcaatcttccactcttgcacttgcattcattcggttctcctctcagttccgtctaaatcccctcgtcctgactaaagcacctctccgtgttccgtcgatcacctagataaattaagtatagtaataagaatgaaaagtatggcttggcgtgttggatcaatcattcattgctttcatcttgaattaagtatatagaaaagaagtgttgtctgtgccaagtctagaagtggtagtattagcgatcctattgaggtgtttatcgggttcgctgctcgaatttcaataaagtcaagtttcctcaatcccgtttctgttgagttgccaagatttctcaatccttgtattagttgatccttttgtttattcgaaagatcggcgggatgctacttcaggtagggtacgggcgctctatcattgtcttattttaggtttctgatcgctagcctgccgggccccccatcaaactatcaatctcataagagaagaaatctctatgccccctttttcttggttttctcccatgcttttgttggtcaacaaccaaccacaactttctatagttcttcactactcctagaggcttgacggagtgaagctgtctggagggaatcattttgttgaaatcaattaatccaatatgcgacgaatctttttgtttgatgaaaatagtcttaattcaagttccaccattgatacatcttctgcttccaccattgatacatcttttgcgagtcaatgcactaacttttctagtggtcaagcgtccggtactcaggatactcatgctggtatttttgaggattgtccgggccttaatcctaacaatgagcgtgtagtagagctgcaatgtgagatacgcgagaagtgtgaggcattaacgcaagatcccgaaatgggcttgattttgggcgaagctttacatgcggaaagcgacaatgtcccttttttgcagtccattgctgatgatttaacccaaaacggagtatccggggaagcctttcaagaagctctgaatatagtgggacaggcggcggcctccccactggaccaatttgagattgtcccattgattcctatgcatatcggaaacttctatttctcattcacaaatccatctttgttcatgctgctaactctgagttttttcctacttctgattcattttgttactaaaaagggaggaggaaacttagtcccaaatgcttggcaatccttggtagagcttctttatgatttcgtgctgaacctggtaaaggaacaaataggtggtctttccgggaatgtgaaataaatgtttttcccttgcatcttggtcacttttctttttttgttattttgtaatcttcagggtatgataccttatagcttcacagtgacaagtcattttctcattactttggctctctcattttcgatttttattggcattactatagtgggatttcaaagacatgggcttcattttttcagctttttattacccgcaggagtcccactgccgttagcaccttttttagtactccttgagctaatttcttattgttttcgcgcattaagcttaggaatacgtttatttgctaatatgatggccggtcatagtttagtaaagattttaagtgggttcgcttggactatgctatgtatgaatgatattttctattttataggggctcttggtcctttatttatagttcttgcattaaccggtctggaattaggtgtagctatattacaagcttatgtttttacgatcttaatctgtatttacttgaatgatgctataaatctccattaaagttcttctttcttttatttatatttataattgaacaaaagcgagggatggatgtctgagcggttgaaagagtcggtcttgaaaaccgaagtatttctaggaataccgggggttcgaatccctctccatccgcgaagtcataagttctctcttgccgcctgataagaacgaatcggatcgactcgactgatatgatagatggaatgggtaccttgtgttatgattttgttaggaactttgtctccctttcgttatcttctctttttttcttggtcggcaagggttagggcctttctcgctgggcgagcgcatccgattagtcctttcctaagccacttcccgttcagttgctgaaaaaaaaatggggataagctatgcgacgacagagaaatctgaatctactttttgccagttccacgaattctgcagataacgacgttctgccaggagtgccagttctggacatgtttcctaatatatcagtagacaccataattaaccaccccttctactgttcgggtacagtagctctcgcagaagaattggtggatcctattattatggagaggtggatagataggacgactagttgctcgatcaggaccttagctttattgcgagcctagaagtctctcttttttcggaacagcctttaagtaaaatccaacctaatatcattcagagtaaaaggactacggaaccaaagagaaccacacttgcttcgctaggaatgaagcagcacaccaatgggcaaagggtatgggcgacctatctgctgcgctagagaaagaaagaaagtgcttcgggctgctttgctgcgctagaggaaggagactgataaggagaggagtgatccaagctcaactcgatactccactcatctttctcgattctattgacataatttggtttcttctatattagtgaaatcattacatgacagtggatcttgcttggtacttgtccgaggggagatccatactcaactcatctttctcaattctactgacatgattacttggaattgattgtcgtgaactcaatctctcatataggcatagttgaatatcgcgaagcaaaaacccaaacttgaatatcgcgaagcaaaaggctacatcagacgatgtacaagtttttcaaaaatgatttgatcgattggtgtgtttcgatcttgttgattcactaggtaaatcacagcctcatccttctatattacctgttgatcgatcaaaaaaagcaccttacctcggatcaagaaaaaagaagaaaccgaatctcggaaaacgacaaatcacacagttgaacaaggtgggagtagctcgtgtgatctagtcgaaggtccataggaaactgataaggagaggggtcttccatctcactattctagattctaccgaattagttggaattgaattcgtccaagattaaatgccagttgaatgtcgactagtgttgaaggtccaagctgtactcgactcataattttgcttttctataccttactcgtgaaatcgatgatgattacatgacagtttaatgtcgccttattgcttgatccttatcttgtatccaaaccatactcaactcagaatctactgacgatcgaccaccaactcatgattacaaaaaccctctcttcgaaaacccaataatcataaaccaactcgtcgactttggttgatccttcacttggccaaaggtcctagccgtacttccctccactcataatcaccaactctatcaaatttttagaattgaaatgtttgactattacaaaagtacattttccatagagtgcaggaaccccatcccctcacccctcatcatctagcacacccttggggttcacatacggttttaaaaagcgaagcaactcttcatactcatggcgaagcacgcaacaagccgaaccctcaatcccagtgaggactactccgttgggggttacttcgcaaggacgccgcatgtgcagttcctcagtcttccttctcctccatatgaagatttatcccatacggtgctagcgaagcaagtcttccgagttcatactgcatctcgaacgaaggtcactcacagttccgaaggtcactacggtttccgagtcttattgttcttcttcttccacgtatgacagataccctcaaccctcaggcccacggggggttgctacgcccagggctactccgttggccctgaagggttacttcgttagggctacttggaggagttgaccaacccgaacatggtgccttgatcttcagctttccaataagaagatcattgatgcagcacactgagctaaattcttaaactatctttaccggtgtgctgcctcgcagagattctcaacctagtccgcgcatactctttccgtttctgtcttacagtctttcttgttcttcttttccctatagttagaagatgagcccctggggtgccctgcccttcttttacggctgatggacattcaatagatttatctgctgttgcctgatctacgaccccctcaatctgtcgaagcaaatgctgcacagagggagaagttgcctgaccgggctattcccttgttatctgttatccaactggttgaatagtaatctgtgctggatccctctgaagctggtcattccttgtttccagttaatagtggagtcttacttacttgaattcctattactgttagctattagcacttgcttgttaggtgaggactctcttatctggttaaccttagtggtagcacactccaagtctagacaatcttcctcccaagaacctctcgataccagaatggctaccagggcgctactagaccaactcagatcagatcgtcggcataattaattctttttacttgcccagtagtggtctctgaagtttactactagtggtagtgcagaagacctctttacctacccggctactgacaggaaaggatgattttagattctttgcttgcccatacgccgatcctgttagctgactggtactacgaagatctatgccattcaaaggagagatatgaatacaccaactacagacaagaaagagactctaagtccaacccatgtcgtgggcagggagagacaggcaggcagctaacacagatatcagatattagacttggcaacagacgctttgatatgtgttacacagacgccctgtagacattgaatcggctcactccgacttcgattgctaaaatgttgacgtgaatagtgaatacgcttgctggttgtgatatgttccctactatactactattgaagaccttgacttttgatcttccttctaggagaattcatcaaaccttgcttatccttctgatgagcattcctctaactaagttagactgcctcttacgagcaggtaacctaccttctaaaccatgcccactatactttcttctaagccagcttttaactctttgttttcgtatcatctcattggacttatttcaaacaaactcgttacactcgcacctgattacacgggaacgaagaaaactacatggggagcacgcttacacctgcaagaactaagggtccagaccaagcacagacagatagaaccagacatcaaaaatcttcctttgcagcctatcagatatggaagttttcgacctgtctttcactggattgaaaagccttgtatgttgataggactatgtgggctgcattctgaagtttctttcatcgcaaactggccatggggtaaaccctctgagatagggggctgctcaatcccatgtatgttgacagggagagggagcgaactttcttatcatatcagagcaagccgaagacctcttccgggaaatcggttccacttccaatcttttttttgaagaaagaaaagtagcaagagaatggttcaagttcggatcgagtaacggtgattgaagggatgagatcggaagctcctgattcaaatagttaactgggctgtggttgtcgagtctgctttccctctctatcaaagcccttgcacctgccttctcagttcctcgtgcttagcgggactccttttctaattagaaggagacagattaggtcaagttgctccaggtatgaaatcaatcccatgttggtcgtaagagtggcaagccatgaggtaggtcttatggaaataaataagcatcttcctcaagcaactccttcatctgtggcggctgctcctccaagacaactgcccagcataactaaactcttatctttgacttgactctcttttgttctatgccccttaggtaggagtcagatctgttttgtagcttgtttcacccttctttgtagcttgccgtttggtgtgttcatccccgccctccctgaacggagctgttgctaaagcataactaatatcttagctgtttggaacgtatagctacccggttcttcctttctttagcggaggcgtaggtaacatatctatctatgagttgctgagaacgtctccaaagcataaggagttgttcttcaatttcaaccaagaagcacaggttcccgcaaccctgacgccagaagagttgcaagacgtggtctggtcgaacagattacgaccgctgacctttacagatcaattattttccatcttgaaagaacagccggaaggtatgaagctctagtccttctttctagccgtaaatcaagaactcgaaaggtttattactttgtttaatcgcttgactagcttcgaaagagcaatctcctcttctagtcttaccacaaatcaatgctttcaagaaagtgctcagttcctgacaacatggttcccggtcgcgcatccccatggaggtggatatttcacacattggggtcatcagccgtcgaacacagtcaagttagcaaagattcgtacgaaggaaaagaagaaagatagatggtttctaatgggaaggtagcagctgtcatcattatgatgattcaatccatattaatccctatttcagaactatgtattagttagacgacgtcaacggaacaagaactccttcctttacaggcaagcggggtagctgctgtctcgtttaggaacttgagttagtcgactaagaggtagaaagtggaaagaagcggcctaaaggattagcgacgacccctctcggcttaaagtaaaggaagcggcttgtcccatccaatgccctacttttaagtactcggtatgttcactcaatcagaagaagctttcggaagttcattggcctctgcggagcatgaaaaggcctgttttgaagctccggggacttattagcccgtcagccttacttcttaggaagaagagaaatgtgcttgacttcttcatcttataagatgacggcaacatcctagataagatctacgattcctgcttatgaatcatggcaaaccggtggtgaaaacagtattacagagtaggttggttaaattaaagcgggttactttgatcttatcgtctagccgggcatgagagcccaataaaaaaggaccgacgacgatccgagaaggacgaatcaataaatcgacttcctttagagcagacagactacgcgctaacagctttagaaactttgctatactaacaaagcaagcatagcaaagtcaaagtttgagttagaccgggtatgaggcaaagccaaaggcagaagtggtttatccaggtcggttgaatccccgaaataagcaccaattgctaccgtccaatcgctatcattatcatggttggagcatagatagcaaaggtatggttagaggtcaaatacacatatctaccaggtaggtgaaacgaattccatacccatatcgggtaatgggcctccaattacttcagcctaaaacgaagtctgaggtcgggccttcctggacctgccttaaaccctccatcttcctgtcaacgggactcctctctctctgaggaggtccgtaggagtctcactagggatctccgttctcagtgagcgagaatcggtatggtcagagtactgaggcctggtcaaagcatctcagcctttcttttgtagtaagccgctcgtatcgctcctctagtttagttaattaagctagcttagtttctcgattgaaagacaggcttacctccccttcatcccttgcttctttgaaagtgctttcctgagagtgtcggcagagtgcattggtcacagacgtccgcacaccaaaagcctcgtatgcagatcctagtgccaccatctctgctgaagatgatgccttctccatggcacctgggaactagtaccatcatctcctcatcatcagagagttgtgggtcttatcgggttaaggggatccctgatggcagtgttgagcggtacaaggctcgcctcgttgcccatcagcggcctgggagagagtcttttgatagattaagccctgtggttaagcctatcactattcgtctgagagtcttactctataccatggctggactcttcgtcaattggatgtcaacaacgcttttctacagggtcacttaaccgaaaagagtcatgtctcaacctcccggtcgatactcttcttctctttgcaggtttcgaaaagctatggtcttaaacaggctcctcctggtatagtgatctgatagctgctcccagtccgacacctcttcatttatcatcagaatggaatggaatgaaagccaagcatctactagccgcctagccagtaagggggaacgctcctgcttagtacaaccagaaagaaagaatgcagagtaaggccgggaataggcttcgtaagaggactgtttgaggtactctggaaggacagttacacccatgccagcggaagacttaggataagcggtcactaccatcttattactatgggctaagcagatactatcaccttaatagcagcaaagagcaatagtccttggactcgaggaaggatagaacagaagtcgtacgtacaattaagatgaatcgatgattattccccttcgatgaactatatcttacctgcggcttatagcctatctaggtgaccgactactgagctatctaccttctctttgctcttagaagttcttcttgttataacattaatggagaagacaagttattgtacgttagttgaaatatagatagaaatacaaaccttttcctgttctgtcctaggactttctaacatttgaagcttaccgggatttgctcttccctacctatgataaaggctgagaggggacttcagcagtataatttcattccgctttggacacgcaacaaaaagtgagggaggggcaaatatttcaccgaaaggtgggaggggggccaatatcctgcagcccagctggatcttcccatcattgatcgactaaagagaaagtcggcggatatattggttcgaatccaattaatgattacaatttagaaggacttcattcaatcgatgtttaggatggaacagactagtcgttcagtagtcttacagagcggttactcaatggtacagtacagacgtctttgatccttcttggtacgggagttgaggttgaataagtcgttcagatagccatacagacagacagaatctaatctttttgtgaaagaaaaaaggggatagggagctggcaatgtcggagatcctacctcagaatctttctatttagaagttagggatagaaggtgagtaccaactcgaaaagtatactcacatcccatgtctttagccaaccgtcttgattgaatagatttcctgatgtctagttttcctactgtggaaatcctatttagagtagactcacttcaatgaaagctattacttagtaggtcaaaaagattgactttcaaacgtcagcatcttatcctattaggggaaataggctaaactattggtgtgtaacggaagaaggggaagaaaataaatgatcctagctgtcgaatgcagcttgatcttaatcagaggaatgaaggtctttgaatcgcttatctctcagattgaactgaccggggagtacctgagctctttctctgtttaatctgtattccttagttctgttattagctgttaggtgggggaagtataatccctaaggtaagttcttctgatctcatatgtatgtgtactcaggttctactgggattctcgaaagagctccttttgttcttctctttggtttggagtgagaggaagtatcggaaggtgccttgttcagcacactcctctgctttgctttgcttttccgagaccagctatttgcgatcgaagttgaatagttcctatgaagatgcgtaatcccattccgttgtcgtccttcttcttcttgcatttattttaattgtaaactgagcttgtcgatcaaactgtggcttaggtcggaccgttccctaaattattcacttcctcacaaccgagcccttcgagtctttgtcctgaaaacagttccttcttcgcatctctcaagtgagaaggatttggtctcatctcttcctctccttttagtcgagactcttcctggaaagcctaaaccctcactcttccaagtggacatcaatcccggaatagtgtaagtaagaagaagaccggttaggatcacactagtcctggctggcctataacttctcagaaacaaaaagaggcttgcaggtctagtcgcatacccctatcgtcttattgttctattcgttgcagtggtaaactcattgaatactcaaatatggtttagtcacacccttagtgtacattctgattcaatagcaaacagagcattctttgcttctgattccattcctgaaaacaattctatcggcgaatcgaggaactctccccacagctttgcttattcgtgcaaagatccagcattccttcacttatcatatagaataacgatcgacaagtccagagtgtgcaccaacgagagattgaagtacgcttgcaagattctccgaatagcagcattcttctctactatgtgattgagaagtcagttaagtcagtctactgtcccggcacagaaggcattgaatacggctgttcaggctagcaactgattctccggtaagatagattcagtcagttccggccggcattcaataaataaaataaatgggcattgagctaagtcaagcttttttccaagtgttgtaaagaacgggctacaacgaaagtaaaaaagatgaaaacttccgtcactgcgcaccactttgggctctggtccactttcgctctgtttacgcgaattggttgtatctgcccgctaggaacgctggcatctgttgacaacagtcccgctaaaggccgctgtctcttctcggcaaggtaagttagttaggaatcatagcagtcggtgaagctttttctttgttatgcacagatggttgggcgcagctgctaaggaaaaagtgctaaagctttagctgcttgattgaccgaagagcctgactaccagagctagtaagctagcggaagagctcagctcctactataagctgataaagagctactatcaccaagagagggcgaagaaactcattaattcattgatgagggctccccattctctttctaaatctgcagtccaatccttcctaatttcgaaactcatccttaagttaccaggggcaaggtggacatgaatcaagagaataagctctttaatcagaatacatagttgaatttagtaagaaaagaaatgatggttgactcattcaagtgataaatcggatcaagaaaacaccgcccaaataagcttcgccatgagtggatcaggtcctttaaggcgatcccgcgaagccggtccccggtgtctaagatcctatctgactattgaggagagctgatcttcacgacgaacttttgttgatagtgctttgcttaacactaagaagttcgatcatccaacgtagagagaaaaatcttgcgggcagttgttgtgaacaaaggaatgaatctttgggtttcctctcaacaacagaattttgttcaggagtttcagggcaagaatgataagaaagaatgcctttttatttaaaaagagtgtgaaatttgagttcatgagcattatcggctctaacagctttggctacccttttgtattgagtttctatgagctttagaaaccctgggaagacagtgagaacctcactttgacttttgagaagatagacccaagtagcccttgaatgatcatccactatggttcaaaaatatcgaaaaccttctgttctgaggtttcaactgaaaaagggcccaaaatgtcaatgtgaatcagatcaaaaggttcatcacaaatgttattatgagatttaaaaggtaagtgtttttgtttagccaaaggacagattttacaaatggtctgattgacctttttattcttatgagtagggagtcaatctgaaaggatagcagttttagaagaagaaggatggcctagcctgttatgccaagtgtgagaatctgcaataacagaggcactaaaaaaagtagtacctgaaagagatggatcagaatccaaaacatagaggtttgatacttcacataaattttcatttttacgaattcgtctttctaaattcaactattagcatagcattaagtagtaaacattttacactaggagctgcgcccataccacacacatacatgcaaacataacaaatcaaacaaagacaaagaaaagctatttctagtatacttcttcacttcagataatccaaccgagatgtgattgcgatgatgctaccagaaggaggtgatgtcttcgcgctacgatcgaaagatcaagaatcaaataatgacttttcgaggaatcatgttaacgaaacgaatccaacaggcttgaccgcatacctactcctgaaaggagtcaagcttattacttttagttactagttatagttatcccgggtaagcatacttttgagtagtttcagtgtattcaactcttatctatagaaagcgagcggagtccagtagtgaaattactttatttagtaaatgaatacagtgtctactaagaaaagttagaggtaaggcgggaacagcttccatctttatctttattaagctggaaaatagaaagccggggctccagtccagagattggatcatctctacgttcatttttaggaagtagggtacgtctaaggtaaggtctgaagccgatgttcattggccttccgcgcctatgatttcttgaattcctcgcaggtcaagcggctgaactctttttatctttttttttgtgtctatccggtcttccactgttcttgccttcttatcttaagcagtcgctaggctaatgggtatggtccaatcaatggaacattcttctgaactgaagacggaagcaagcgcatttagtaataaatttcttatacaggatttctttcactattagattcagtattagaaaggtctgggtgatcgcagtatattcggacctgtagttagctcagcttgggcagcaccccatttttaggtaccatcaacagcaagaccatacaaatgtcatcgcttattctttcaacatttgcggagcgtctcactgaactgggtcaaagaactaccttcctggagctacctccttacttagatcgttcgttccccaattcaaactcgggcaaagttgtccaggtgggaaaatatctaccacctgaggtaaaacataaagctgtagacctgcttcgtgagtacaaagacgtctaatccttcgcctgtgagacatctacttagttatcggtactcggacacccaatcccatccccgaaagacagaaggaaagacaaagattaccattaggcgaaagcaggtccacaaggtgaagactctctatcgtcagatcgttggcagtctagttctgctttctttggaatcgaagtttaaggcattcagacatgggattttttaagtgcattcagcatcagtatctgctttctttcctgatgtaattgcagagaagatgtagacaaaacttacttaatttaattcaaaccctgtgcgaaggaactcaggaatcacttccccttcattgaaaacaacataagaaggagtgttctaaggccaatagacagaaagtgagtgcttgatgtagcatatctgctgttcactatcaaccataggcagactaagcaaggctcgatggaattgaggttcgatgtaattgacctgccttatgttggacttcccaacttacctagcggaagaaaagggctaggacctataaatataaatatgtataggtcacttccaccaacaactcaagctatttcttactgggattctccacaagtactagaaagtatgggatctctacaacttgttccacaaactcaaactatcggtcaaggaagcatacgcctctaactcggttcattccctaggtacccattcttgggttcttacaaggtaggctcgtgcccgggttcactcgtgaaagaaaggttatagcggtaaagtaaagaaaatcctcccttcttgcttccttagggtacgtcccctatcgcctttcattcggaaaagctcgagtcattatccttcctgtacttcaagtgagagctagagcgcttctttctcaattacatcgacccttcgcaccttggaatattgaatagacacttttgaatcccctctttcgattagtaggggattccttagctgagcatcaatcccattctttgcggataaaagtacactaccccgcttgcctgtaaccttctgcttgcttgactacagtcactcctattaggtcacgaacatccttaacttaagagagcaggaagagtttactatcatagcagcacatacagagtgccggaactacaaatggactaatgctttctctgctttccctcttggtttcgttcatggaagatgcggcatagatagaaagagagcattccagactattctctagcatccgagtctgggcatgaatggaagactcctagctccctcctaccacacttaagtatctcttctttagcgggcgcttcataatcaaaagattgttccataccatatgacccaggctttgtcacgagctggattcgaaccagcacttccggatgagttacatccgacgaattcccacaactatagtgatttcccggttcctcattccattcatttcagccggattgtacggcgaaactcgctaatagatagagaaattttctcagggaagaagaacatctatctccggtcttgtggaacttctgtcgtcccgttcattgtgcttcctcggccctgctagccatttgcttgctcgaacaactggaagtccccccaccccattctttgcctcatcctggggagcggtttgttgccattgaaatcccttgttgaaggggctggcttaccaaaccaacttaccaaatcgactctccctctactctctacctttcttccctacaaactcttaacctcaatccagggctaaggggactaacaactggcttcccatcactaaccagctaacctccttagaaaaactctatctcctgtttcaagtaaccttaatctagggctaggggaactagggacagatctaactcccattcctccaatccttaaccaactaccaattaaaagattcaaagctcactgagaacagatttctatagttataatttcaattactgacctttctcaccctcgctcaattcattgataattttggctcaattcttccattagttaaatgggaaagaaaggctaagtaaggaagtccgtagagtagcggagctaatttcagggagaaataaatcactgaaacacagtattcgcaccttacttgattcattccttccacccgaagcccctgctgcctgcctgggatgagcgtcctctgatctaaataagagctcctgtttgctttctggcaatgagctagcttaaccctgattgcgacaggcttaatacagtcatgttggatctcctattcgttctgctaccaggaagagaaagaaagactgattgcgacagctcaaccggatgagacatctcttatttacagaactgtgccaaccgtgccttcctaccaactccgccaaccccagacggggatattgatttagccgcacctgaacccgcaactgctgcctctactccgcctacttcttgtgccgacttcgactgccttatttcgggtgaagagtaaggggtggtaggcttagtagggctcgaacctacaatataaccgttatgagcggtacgtttcaaccaattaaactataagcccctacggatctctacatgcaatttgctcacttcgggaagagcggacgcaagcaaaggggaggcctttgctctatctgcttcttcctcttcccaggaatgcccaattagataaaataatgattttaatattgtttatagatagataatcttatatatctattatttataataataagaaaataaagcaagcggtcctttcgcgactaaaactgccggtacgctttccggctcgcaacgactcaaaacgggcggggggctctctatttgcttgcaatgccggctgttcgcgtttagttaaaagtagaagtagagggcgcccttttccccacacttaaaaaaagtataaaagtctaaagtacataaaaagtaagaaagaaaaacttagttacgggaacatccaacagaaccttgtgaataattgtcgatgaaaataacatagtacttcaaaccttgaacagaggagaggtaactggggcgggtctcaataagtaagagttcatccgttctcaaggaagtaaagcttgagaacagagcgagccttacagcttgaaaggaacctgaaagatggatcttgaaaccttggggaaagtttcctacggcgagctcgagcagaaggcgcagccgaaggcgcagccctacttctatccaattccggcaaggtaatccaattggaaaaccctgactgaacgcgaggatgttatgtcgacttaatccgtggttgaatatgttagtatctagattgagtatcataccattttccaaagaaagatagtatgctaaaatattatgctaatatggtcatttggtatgctcttatagggatagagcactatgtaagaggtctcgacgagcctccaccatactaagctaaggtctactagctatagtagctagatgggaatgtagcctagcagctagtagctctcttcttatagctcggtagttggatctttcataattcctttatggttagagcacactgggatagaagaatagatgagtttgtatctttcttcctactttttttttatcggaaaacagagctagaacaaggaacaagcaacactagcacttaaaataaggtaggcggctaaaacaattgggcatttccttgatgtccggaaatggtatatctgaaaacagaagaaagactttcttttgaaccaaaactaaagatgatccgatccgtgcaccgcttttcttctctaccctttagaatccaaggaaaaggcaaagagaaagaggttgcagagggcacctaaccttccaaagacacagcagctctagcctaacttcggattcgaaaccatacttccctgacttcctctcaacaagaagttaaggctgaaagtcctaatcttcttatcccgatgcctggagtagcgggtcttagttcggattagtaccttttgagcaaggtaagttaagtttcggcagtgaaagaaagtaaccaggatccgcttaaccagttatggatgaaggtaggtctactccaatccctcagccaataaacaataaagtaggcacatttccctcggcaaagaaagtagtccctcgctaaagagtagacttgagtatcttcgaagtcaaagccgaggaataagactcagttcgggtagagcaaccatttatattttcattattcttacccgtttacataaatgaaaaataaaagtgaattaccacggaaaatatccacctaaaaaaatttctggggttacttggcatagtcctctaaagaccctatttagatactctttcttccgagttcgagataaggaggaagaatggggcgacagataaaattaaataaagagcaaaaatgcttgactttcattttattaaatataatggtaggtagggcttcttttaggtcataaagggaatagtacttttagctcgttcatctaattctgctggtctataggagtggctcccagggctatgtgatagcacccaaaatacgacggcctgatcaagagagccagaagctgggtccgcccgccggagcttctttcaatttccggggggcttagcttgaaccactcccaagtgccaagaaccggcgaatgaaggctccgtggcggcatcggagctgccaataagctaatccgttcccagtgagctattacgcgctctttcaagggtggctgcttctaggcaaacctccttggctgtctctgcacccctacctcctttataactgagcggccatttgggggccttagctggtgatccgggctgtttccctctcctagagaaagaagttctctagtcactaaagtgcgtttcactctcgttcctctcgtttcactcgggttgctaaagcacctctcctctgccaagctctctgtcttggttaatggttatccaaaaggatatttctcatgttaggcggtgtgagacagggggataaaggatcccccgttgttattttgtattgcggaagatgtcttatcacggggtcttaccgggcttaatcacctgggcattctttcttcaattaccgagacctgtacatacaaagatctaggcagctcatcttcttctaacgaagtcagatctttttccataccataacatatatagaatcgattttcttttctgatcgctagcctgccgggccgcccccgcgatcaaactatcaatctcataagagaagaaatctctatgcctcctttttcttggttttctcccatgcttttgttggtcaacaaccaaccacaactttctatagttcttcactactcctagagacttgacggagtgaagctgtctggagggaatcattttgttgaaatcaattaatctaatcatgcctcaactggataaattcacttatttttcacaattcttctggttatgccttttcttctttactttctatattttcatatgcaatgatggagatggagtacttgggatcagcagaattctaaaactacggaaccaactgctttcacaccgggggaagaccatccggagcaaggaccccaacagtttggaagatctcttgagaaagggttttagcactggtgtatcctatatgtacgctagtttattcgaagtatcccaatggtgtaaggccgtcgacttattgggaaaaaggaggaaaatcactttgatctcttgtttcggagaaataagtggctcacgaggaatggaaagaaacatattatataatatatcgaagtcctctccttcaaatactggaaggtggatcacttgtaggaattgtaggaatgacataatgctaatccatgttgtacatggccaaggaagcataaaatgattctttcattctatagatacctctggtaggtaaagcactcgactgtgctttattgaaagttcccatcgcgggggcgaggatacttgccttcgcggttcgactttcttttcaggcttgactcattcgctagcttctcctcccctttagagctctttatgatgcccactgagtaagattcggggacttccggcgcagaagctcattctgaaccgcgggaaccttcgtctcaatcttcataatcaatttatgccatcttaaaaaaattggaatcttgttaggtacccgtacgacagctctaataatgagctaacgtactcatctttagagtggtttgtgcgcaggctcgagaagttgctgcccgcttcagaagaccttagggtgccttcgattcctggacgactttgttcgtcgtgtacaggggacgggaagagatggctgttcgctgtagcaaaattcaacgaaccgacgggcgtcccggacatagccttcaacccgcaaaggttagctttgttgctggacaaccactagggtactattcttcctggcccctcttcgccctatcacatcacatggtggtgtggtatgcggcagaacatgtctatccttcctccttcttctttcagtcgaaacttcctcctagtgaggtgttcgcctatccaggtatggaagtattcaatgaatacactctgtaccatgcatgggtggatgaagctttatctggagtatcaaagatggaattgtatgctaaggcttagtgccagtatagagcttgaagtctttatggatgtgccgatctttatccgtacatattaccgacctgcgaacatggatgattcgttcaggtacgggataatatttaggatgtacgatttggctgtccagttacagtggggcaatgtcatgaaattgctactagtaactaagactcaagtggagaaaaaaaaagcactcaatttgaatgtaagtaaaacacgggatggaagaggaggcctgaaccaacagggatgaaacagtatagattcccctgggcgaagcaagtcaccgattagtaacctaagaaagagttgtcaacgggcgagtgtcctgctataaggtaaactcctactatttcagcttcttttcccgtggtcgaaagctaaatatctcaagatgatattttccaaactctcgacaagcagcaaatagaaaattaaaagaagattttgaaggatctgatttcatctaaggagtggcggttaacagaaggccatttcaacttatgctctaaaaagatagaaagcattgttgataaagccctctctttatataaagagggctttgcgccttcggataaaggaagattccgatattcgcataggtattgaagcggggatatgaacagctagcttcccctcaaatgggagccgtttaagtaatcttaaaagagtcctcgactgtattggaaaaacaaaaagttcaatatggcgggagatccataattttattgagagctttcaatcaaattagattgtaaagtagtagtcctgtgtaaaaaaaaaagctggtggggcggggtccaagcaagcgtaataaggggagggggactaggggtggaagggtcgtcgaaggagatgcatttctggtacaagtggtattggacaagatctcagggaatcatctctttcagatttctgcctttctttcccatgacgactaggaaaaggcaaatcaaaaattttacttcgaattttggacctcaacatcctgctgctcatggtgtttcacgattagtattggaaatgaacggagaagtggtggaacgtgcggaaccacatattggatcactccagtgcggcacgaagccgctgacgccgagtcggctcctatgccgctagctatgccctgcttggtcccccggcacggtggaggttccgtagcgggtcatgagcaccgggctaaggggcgaagtcactcgactgaaaagagaggggcggttgagcaactcaagcgaaccgccctaccttactacaacatagggacagagggggagaaggttgtgaaggtggcctcgttatccacacctccggtcggatgaatggaggaccgcccgacccgggtttcatgagcgttggcgggtcctggagtgcctgtcaagggcgctagcgcataccccggggtgatcatcatcacctgcacctcacatctcggcgtagtggaacgtgtaacccgcctgctgtctcattcaactacatttgttactgtaatctatagcctaacagaaggcagcgtcgaggggctttaggaactcgactgaaaggagaggagagaaattcccatacagccagcggggaggatggcactacaggcaaagaccgtctggcgaaaacgccgcaggcgcgaagcgtggtaggcctgcgccgggtgagcatagggggggaaagggatcccggacggtgtaagagccaggggaggccgggtcatttgacggaaatggaaggcttttcccctcttatagaaagccctatgaagttaagggaagtgaatgaattcttggaaaaagaaggagcgagcctatatataaaatgtaagaaagtcaattattcaatgaatagatgataaagtcaaccgtacgacagacagcgctgcctacacgcgaattagcttccaaggtcgagcagtctcaatttcactacaggatttgcgaatgaatgctgggctgggccacctcgaatggcgtgagccgcatgcggggagacccgcacgtacggtttttagggggatctggccgaaagaccggccggcgcccacccgactagagggactgagaaattaatagagtacaaaacttatcttcaagctttaccttattctgatcgttcagagggcgatcgcggagtcactgaatgaagtcctccgtttctttcggaggtgctgacccgcagcgaggcagagatgactaagtgacatatggaatatgacgacaacaacagcatgtcgtagaaggagagaacaggtggagctaacgacccacgttgactaacgtatctacaactacatccccgagcggcagtcaaacggaggcgtgaatgcaagatgccagcggaatgatcggccggacagaggctagggctgcttccttcccaccgcgtccttccttgtgtatcggagatataaagcgagtgcaccggaaaagaacgggaactgggtcgatctattgcgaagcatccgaagcataactgcacactcacacgatctttgccgagagataggagcattcggtggaaccggtgaactacacttgcttctggatagatgtgtgggacagagggctcgtggtaccttctgcccacccttcctcctctgctttgagaactgtgtgaacggagagtgggcagaagggaaggaggtcctcatacagagaaaatcatggaatgggtcgagatagatgacagcgcctttttcctctcttccttgccgggagggcaatcttctcttatggtcttcacctcccgcccggcctggaaattgaatccagcccccttctttctgatccattcatttctgcaagcccagagcgttgcctcccttctattgcataacctaaaaagctataagcaaagtaacaaaagcgcgctccgcccggtgactaagaaagaggtttgcgcaacaattaaagtgataaggtcgagggaagtagggctcctattgaaaggctttccctccctcaaaagaagactagctttcagtactagttcttacgttacgctgccatttttccaatattattgaatagcatggcctggggctaaagtaactcaagtgggagagccgtgttatgggtgaccttattgcacggttcagagagcacttgtgtatgtgatgcaagtgaacgtgtacgaaaaagctgtcgtaaagtttcgtttttcgttccgttttcgaccctatctatgtttctatgatggcccaagaacacgctcattcttcagctgtagagaaacttttgaattgcgaggtaccattacgagctcaatatatacgagtgttattccgtgaaataactcgaatttcaaatcattcacttgctttaactactcatgctatggatgtgggagcattaactccgttcctgtgggcttttgaggagcgggagaaattgttggaattctatgaaagagtctcgggagccaggatgcatgccagtttcatacgaccaggtggagtggcacaagatctgcctcttggcttatgtcgagatattgattccttcacacaacaatttgcttctcgtatcgatgaattagaagagatgtcaaccggcaaccgtatctggaaacaacgattagtggatattggtactgtcactgcacagcaagcaaaggattggggattcagtggtgtaatgttaagaggtcgtgcgacatgaagacattgatagcaatatgggggaagttcccatcaggcaacaatggttccgcctgactctacttaagcatgcatattatgtaagtgaagacttggtgtgaagccttggagcttacgttagaagagcaaaaggcccggggctagggtgagctggggggggacagcgtaagtgagcgaatgtgtgtaagcccagtcaaagatgactgttctaagcggggggagccacccacctttgaatggtgttggtcctacggaccgtgaacggatttcgcctctggcctctgggcacgtcggaaccgcgtgagttcaccggggtggagcacggtccgccaaaaccggcatagattaggtgctattgatggaacatggtaagcctatctttctccatatggaagtgctgcgagcacttagagatgcgggtagaggaagcctcaaaaagcgaaggccgagctgtaggtcacgtgacctgcaccgagttggtggctgactgggctttttccttgatcaaagcagatcaactcgccttctttcttgttacccaaaactaaagttggtcgaatggtttttttcctgccccggaacgtcgaatgaaatagggggccgggttctctttctacaacccttttgatatgataggcctggctacctttcccctatcccttatgattagggggctgttaagcccaagaacaaccagtcttgtggtggtacggaaggaacggactccgcgaacgtcccgcgccccggaaagaaagtctcaaccagaaccacattccttttgcgtgcggatgtagctaagtgtctgactctattggtcatagtttcctgctgttgcggctggtgctcgtttgcgcgcgcgtgaaccaactcaacaaagaaggaaaggatgcccggggaggcatctgagaatgattcgagccgtatgaagggaaactctcacgtacagtttgttttttttggggggggcaggagcccgacagggtcccccactgactcggcccgggcctaagttaaagtgaagtggtgggcctacccatcccaaccaggggtatgctgggattcgcgaagagcagcaccttacgatgttcatgaccaatcggatcttgacgtaccagtaggtaccagaggagatcgctatgatcgttactgtatccgtatcgaagagatgcgacaaagtcttcggatcattgtgcaatgtcttaatcaaatgcctagcggcatgatcaaagccgatgatcgtaagctatgtcctccatcacgatgtcgaatgaaactatccatggaatcgtgcgtcgtgtgaaacgtagatcatcgccgttcttaaccaagactcaggttaagctccgtctcggaaccttgtgggttaggagtaaagcatcccggggttggcgcatctcattgggcgtagagaagcattgggaaccccaatttatttcttcggagccgtttcttttcccgtcccccccaccccggcatagcgcttcgcttccggttcttcggaagaatcaacttacttctaccttcttcattgatctgggggaaaaggaaccgtctaccagttgggaagctagacatcaagtaagtggcttgatgaggataactaagctgacacgccggagttggctgctggcacaacagggtggtgccttaccgcactgcaggcgaacgcgcggtagcgttcgtggtggtgcttcaggattccaatgtactgcgtccaagatcagaacgagcttgccggcggaccactgtcgtcccattcttgagtgagctggagcgcagccatcttatccactgaactagctagaagctatcgcttcgggtcgaagcactaaaagaaaagcaccgggaaacgcggcggcataggaaccacgggacccccaccctactagtaaagggaaaacggaagtgcgctcctgcgcaccagctgaaaaaagccctttcccctttctctgataataaggaaagcttcttagctccaacctatacaaggggtttttatgtcctttttataggttgggttgttggatacgggatcctcgtagtaggctggaccaacatccagccgagagagggcagcctctagaagcaacaggttgggaaaccaagagaacgcttcgccttttcttatcttctttctgccctaggagtagaattagcacaaaaagagggattcgcattattgacccaatgataaaccactaacaccttcctcgttggggctccgcgcactgggaaaacgctgacgcgatgggaaaccggccactagttacaaagctccaataaggtatcgagagggctatcacagtcaggtgcgaagcaattacccctatttggaaagtacccttcttcctatttagggggttaaggcgagaaatggcttgatgaatcgttccgttcgccatgcaccggccccattcacttgcttatcgtagaggctgtaagtacacagtgccccacaactatcaatagtatagtggggttgaaagacgagagtgcccgccctttcttttctttcaagtgggccacttttttcccgaacgcagtccgggatcaccgtggccgtgtatatatatatatatatcttcgatgctgtcatttcgaaatgtccgcttcaatcgctctttcacctccccccaaaaaaagcaaagttggcttaacgagcgcagatgtgaggaagcgggagcaataaaacaaaaaaatatctttcttgtccttctacttaaggggcaaagagaagcgcttttgctactgagaaagcgaacggtcagcgcgaaggttcaagacttttctgagcgttagcgaagctagattctcatagcgaggcgcttcgagttagcgaagcgctgtagtagcgccgaagccctatgtgctataatgctgagccaaggacactccgccttatctatagaagcagtcaactgagttctgaacgaattagatccttggtaaatggctcaatctatagatagaaagccttatgatgggaaactaccacgttaggtttggagagagatgggaccggttatataatagagggagcagatgcaagcttttttctttcaatagccggccaaatgactacaggatcatcggtctactctacctcaattcaccatttcgaactttatacagaaggtttttccgtaccagcttcttctacctataccgcagttgaagcacctaaaggagaatttggtgtctttctggtcagtaatggaagcaatcgtccctaccgtcataaaataagagcacccggctctgcccattcacaaggactcgattctatgtccaaacatcacatgccagcagatgtggtcaccatcataggtactcaagatattgtgtttggagaggtggatagataggacgactagttgctcgatcaggaccttagctttattgcgagcccagaagtctctctttttttcggccttcaggaacagcctttaagtaaaatccaacctaatataatgaatatccttctacatagaagaaagacactctaagatcctttttcaaacctgctcccatttcgagtcaagagatagataaatagacacgtcccattgcactgatcgggggcgttcgttgtatgttgaagcagagatgaatagggtggctgtgaagagagtgatggttgatcctgactccacagtcaatctcatacctatgtccactaggcattccaaaagaaaagattggaggagcacttctcgaggtatataatttgagttcgaattgtcaaatcaattttctaggaatggtatggtcagagtcaattgcaacgttggaccttttcaaagtccgatagagttccaggttgtttttgcaccgacgacacattatgctcttctgggcagactctagattcataaagaccaagcggtcccatcgacataccatcaatgtataaaaggtataatcaaaggaaaataagtactcgtaccagcggtgagcactcccttcgaaagatctgaaatccattttgctgacgctatacattattcggagtttgccgaggatggagagctttcagggtccagggagctgttggcttactcgttgggaggacttattaattaaggaagattcagttcgtatctatttatagaaaagagaccaccggtatgcaaaagttgagaaaagccgtctttagcctgtcactaagttgccaatcgacatgatctatttgctcacattccaggcgaaggtcataattcgctgtttcctacaggtactgggacggaaacatcatattcccgaaaaaaatgcgggacttcggtagcgaggagggccctcacagcaaagcccattgccaaggccagacccccagccgatcttgatgatcaagaaagaaagatggctcgactccctactaggtataccccaaccttagatagtagggccataaaaggtttccctaggaaaaaagaaagagaatcaaatatagcgagaacacataaaagaatcgagattctgatgagaatgcaaccactgcgattagaaagggttccgcgattgtaattcacagtcatttcttcaagatgtttctgccattcccaacaaatcatctttagaaagctgcagattttccattctttttaatgccttaaatacggattttttataatcatctgtctcagtactcatctttttacttatttacttatccttcctgagacttttttcagtttatcgtagaaattagtccacaaaactgataagaacgacacgagtttaaaaatttcgattacgctgggccatgcctggcactttcattttattgagtcataagattaatttaatcaattgcctcttattttaggcaaaaaaaacaatcccatttgttctccgcagtccttctgtgtgtagaacattggccagctccatctaccaatgggtgcacctgactgtctccagttcagttagaacagaaggccgccagcttacatagtatataattgtagcggggggagctgactgttgcctccctagttgacaaatgagccaaatataatttaatcctatgtgctctacatattttctatttatttcttatctatcccatttagcgataagatactcgggttatgtttggtgaactggggccgtgttttatatcctccttccccacgggaaaacgtttgcagatgcgatcatgaatcgaaccagatcgaaacattcagctgtcgacggacaaacctttgccgaaacgtcgaccgcaaacgaaggatggccaggccccggttcccagagttatagtattccctattcctcgcctactcaaataagaactagttgattctctttcgcctatcggccggctggcttgttgcaaccttcgcatttcctgctgagatcctaagtctccaagtgggccctcttggccacccgcgaccttggctttttaaagaatcccgctcctgagtcgtggaacttgtagctcggcagtccaccgggtgggtttgtttatccttccagtttcgagtgtcttcttggatagttatagcggcccataggcgcgagatgtaccttgtggggggggggggggcggcggtcccctggacatagtcgtttcaggcagtggccgtttagtccatggtccattagatgggaggtgcaaggccagaaaattgaacacattgattccgctcgttcccgtccttcgcttcagggcctgcccctcggtgtggtcagtactccatactgtcgggcagcgaagcttacacttgttcactaattatgacggttcgccagggcctctttcctcctcccttttctgctcactcgtaggggtccggacccccacaaagggggagggagtcgactgaacatctcagccattggcggaaatttcgcccgcatccgatccccaattcttgttcaccccggatgatcgtgttgggtgaattgtgacctcgtacgatcgtgtcgggtgagcaacagccgcttcgtcacagtacttacttatgggctaacgggtcacactttggccaagtatcctacaaagagactcccgagagccagaagtattgaaggaatggccataggaatgggcgcatcatgacatcgtgagatgtctcgcccgaacgaattagttggtactagaaatgttagaaaaagtaaacgaaaagagtaataagaagtgaaaaggacagaaatacttcccaaccagaaagcaaagttcccactgatggtatacttagtgtaagcgagctctaagatcacatctttggaataaaatccagttagaaaaggaaatccaattagagataagctgcctatgagcatcatggcataggtcaaagggaaggaggaggcaagcccccccatcttccgcatatcttgctcatccgacatggcatgaatcaccgaaccagcactcaggaatagtaatgctttgaaaaaggcgtgattcattaagtgaaagacgctaaccgaatagttagagatgccgcaagcaaagatcatatagcctaattgactacaagttgaataagcgatgaccctctttagatcgttctgtaatattccagtggttgccgcaaggaatgacatcgtagctcctgcagaagtaataacaatcaaagccgtaggtgggtattcaaataaaggggagcaccttgctatcatgaaaacgccagctgttaccatagtagctgcatgaatcgaagcggatactggagtgggaccctccatagcatcgggtgaccaagtatgcgatcctatctgcgcggatttcccaacagcaccaataagaagtaaaatacaaataagacttatggcattcaatctcatattgcaagaaatccaagaatttctgggggcactagcacgagcaaaaatggttgaaaagtctactgtttgaaagagagtaaaacgacccgaaatcccaagagctaatccaaaatcacctactcgattgacaagcatagcttttgtagctgctttatctgcctgaagtcgtgtaaaccaaaaatgaattaacaaatatgaagcaagacctactccctcccatcccaggaataattgaagagagttatctccagtcaccaacattggcataaaaaaagtaagaatggataaataacacataaatcgagggctatgcggatcctcggacatatatgaaatggaataaagatggaccaagctacttatggatgtaaccacaattaacatcactacggtcgggctatcgaacacagagtcagaagtgaattacgagtcggacctatttgcgaatcgagcgagctccccttgcatgcaatgatgtggtggtgaacctctcactctaattcagtgctctccgaaccgtgcgggaaggtttcccatcacacggctcaccaacttgatcttccggcgggaaccgtatgtccaaacaggcctagaaaaacaggtacgattgccactaaagtgtacgaaaaaatccgtgcttaggccccttcttcccttccaagagtccaccacccgccttagtagtctcacaaatagggcgtgcaggcctccctattttttgagtaggtaattcactaccgaagcgcgaagaaaaggctggatcaagaaaagggggtactacgagccctctgccccacgcatctaaccagctcgcgtggttcaccggttccaccgactagaccaaaagagttattcagtcgatacagaggtgcgcttgaagcggggggtgtgctgtccctattgggctgggcccttccccataaggccccaccgtcggggcataagcgccctcttgctacccatatgcgaggcgccgtcttagccttccctgaccaggatcgctcccacacctgtagcgttcgtgatcggcctactcaactgtgtatcgattgaaaggcaggaatttcccacaaccaaagggagtggttacgtccagtatgtccccccttcttcccgacatgctatggtgccccggggtgggtaggagcgggtcgagtccgtatcgccgcggagcaacagccgcgtccggatcagatctatctactcggcaattcatccggtgacttcacggtcgccaaagaagccccaagaagcatcaaacatttccgatgagatccatggagcaattcttagatagcaagcactagctcccggcgcgacttcataaaaagcaatcaaagataagatcgaagagaatgaaacgcacgtagtggtcattatagcgcttccttctgatcctagaaaacgtccgaaaaaacctgctacggaactaccgagcaggggcaaaaatacgataagtagatacataatttaatttcgagtgtgatcaaaaacctaaaatcagacaattacagagcggccagtgattgagtgatagatttctcgacgtccggagaacgctcgaccgaagaaatgagtaactaacaaggaagattttgttccccaacttgcttgattaacgggcattttcggggactagcccgcttcccattactccaagagggcaattcctcgcacataataaaattaaggaagccattgaaaggtgactaaaagaccagaaatagggactacccgagctaatgatagaggcaagaacactttccggccaagtcccattaattgatcataacgatatcgtggaaatgctgcacggacccatatatataggaacagaaagagaagaaccttgatactaaaccagatcgagcccgggatcttcttgaaaatgggaagatctaggataggcggccaacctcctggaaagaacaatgtgcatggaccaggtgagtagggatgcagctccgtggaccgctcgtcgggcctgataggtggtggtatcacacccttctcaaagaaaccgtacgtgacactctcgcgtcatacggctccgccccggaatcattttatacctctcgttttagtcgagtttgtttcacaacctctcccaacaagtggtcgagttcctttgtacctttcctttgaccaaggggtcctcgaaccaacctgtccttcctttctattcctagtcaggcgttttcattcattcattgattgattcaaggtacgaagtgacaagtccaagcgatagcggtaaaagctagtcgccggaagcgaacttccgggccgggaaggggccaaaaaacgtgagcgcccccgcaatctttctaaagaaacaagctagaaactttactttgagaaataccttattatatatatataattagtaaaggcgtgttagcctatctatagtaaggggccttttcttgatcgttagcgctttactaataacaaggacttttctcgcttgtttagtattgctttggcttcgctgtccgtatcttgctggcgcggaagctaccgcaactaaaagaaaatgaatgaaggaagaaggcattagaaagactaccgaggcattccgggccgactacaatacaagtcatgagcgatagcgaagccaagcctatccggcttttttatgtcaaaagccctaccccaaaactagctctatcttatagcagacaactcaggcaagtctactcaactaatctcataagtaaacgcctgttcgcatcgcaactaatagaaaaaaacgactactagactagactagtagttgagtgttccttcttgttcaggtcttgaccgggtccgagcttcccaagctctatgctgttggggaactctgcaaggatcttgccaccttcttgatttacaatatttgagtctttggagtacttgaggattatattccgcgccgaggatttgtgcttgtgggctagggtgaatattgcagaccagcgaatctggtggtcgacaatcgttcggacttgataaaggttgtcgcggcacctgtagtaggacagaggacttatcgcgatgcccgcggaccaatttacgatgtcttcgtcgctgacgttcgtcaaacaggccacgtggattggccagggtcttcttcggctaatgatacctcgatcccgaagccttcggagtatcttttttataggtgcctctatctttatggggaattcgctgctgatagatcccgcccagtgtcctcctccctcccccgccgccttccgacccgggggagtatacaatgacaacttacgggcatgagtgcccgatcgtgagactacctgttgaacgtccgatgacgcgttgctccgacctgagctatgcaagaacgagatcccccttgatccttgccggatgtgcttgacggtcccccataatacgctaacttggggacttctgactccagctgttccaagagtctccgctagttgaaccccgtcctgtagactccctgttttgctcatccccttcgtcagctgtttgatcgggatactatcacctaggttcctaaactttgaatggatggcggagcgtaggtggcaagcagttatatggatacggtgctttacccgtagacgcttttccagctctcgcaaaaattgtatgggagtcgtcctcggagggacttcccgaatgaccgtaccaaggaattctaccgtactccgtgcagctattgttgttgatcctgcggagcctacccaaaggttcaggccagattgtaggaaatgggcgatacgtttttgtatttctttgagaagctctacggcacccacgattcccagtagtaagtcgtcggcatatcgcgcgtaacaaatccttattaagtaatgggtttttaagggggcctgcttacgggccaggcctctctctgacctgataactagtatcgcctccccgcccagctctatcagcaggccctttcttttgcaatacttaagaaggtctctcatggcccaattattattacagcgttctccaccacagaattcagccttcggggtcaacccggcggcttctatgaggaaggcggcgcaaagaaggctcgagggcttgttaaggaagacggcaagggccgacgaaggggggaaaacgaaaggccttttctggtcccccctgagccggagggtgcttgtggggggggtgtgccacgacgaaacaagggaatgaaaggccgctttgcgttgcatgctcttaacgctccccacaatgatggctctgttgtcttggggagcgttgaagcttgcttcttctccagggttttcttggtcatcaatacgacgacctgtccttaatagaaccgatctgactctctgaacaatcggaatttcgtacttctgtcggatcctccctatctcctgatcgagcttgtgtaggtagatgttgcctggtagggccgatagtagtacactgtgtgggacggagtaagggcccctctcaactcctacgagtcgtccggcggaaaagactttctaaatggagtaaatgaacttgggatcgtcgatctcttccttcaaaatttggatgagtcgatgtcggtcgatggtgtgaaaacacttcctgatgtcgaattctaaaaaccagcgagagattccccactcttctttgatccgtcttaggaccgagtggcagccttgacccgagcggaaatgcgatgtgtttggaaactcgggatcgtaaatggattcgagtaccattctgatcgcctctttcatgatcttttctataggtagaactactgtgagcggtctaaacttcaacccttctttctttcttcatattgtaaaggggggaaaagctcgttttttgctccccttttttataatcaaaggccccctcctgccgtcgtttcagtgactcatagggcttccctcagttcagtctttttggttcttgaaaatggtcgccacctctcctcttctttcagtcgatggggttcctctccttttagtcgagtaatcaatacctctcccaggaccggaatgattatccctgcccgatgggtctacatccatccctgaatgtcgtcgggtactgttcacatccccgccattcttgtaaccgtcacctgtaatccgcgcgggtgtgtccgcacccccctgagtggacgagaaagaaaggatttctcggagcaaccccccaggttccagacccaggagtcaactttcccgtatgagcattcggtacatgtatcagtccgtgggaagaggtgaaagggtcaccactactgaggatctcccccccccctaatcttagataggtcgtctgagggttcgccgcggttcattgctgtgcttacacacaaggctacccttctccgaaagctacgcgggaccacctaccactagtcttcggccggaggggtttattgcacaaaaacggccgggacgcaggctcccgaagagggaagcccaacgaatgtcagatgcaaagttccgcacctcattaagatcatattggcatactctcccaaaaaaaaaagagcagaccccattgaagacgagagtaaggtacaacaaggccatttctgtccaccgcccttctcacggaaccgtacgtggacgttaccgctcatacagctcccagccagcaagcacagttagccttcctctacaagaaatggaaatgtggatgaatcgaatgaaatcgaggaattcggtttttcttttcagacatgataagtaagagcatccctttcacaaaaacctacggatccccctcctatcctgccacttcagcaccttgtgatctttgagaagatcattacgagccctttcctagaatgtttttgtagattccgaaaattccagagtggatcaggacgagaatgaatccgggaatccagggcatactcatcctggagcttccgctctcctctgggaagggcttttttatggatagagagatgagtcgagggattgattactcgactaaaaggagagggtagcctcccgtttgaccgatttctcggagtcggaagaagatctctcatctgatgaccctgaacaagaaggagctgctctcgatgtgagatcagcagcaaaagaaagaagaaaagggccatgatgatgatcctatgttcgttttcgccctgcccctatgatgcgctcctagctcgcagagcataagtcagcgcaaaggagagatacatcctttaagactgtgaagagaatccttggtttgacctacggactacgtgggaaatacgagatctaggcaagccgctacatgttctcccccttgcccttgaacgatagaagaactacttatcttctcttagatagcagtcgatcggttctatgatctatggtcaatcaataggcccacggatctattcttctatacgataaattgccatctcgtagcaccacagcctgggggtaagactagaagaggagatttgcttggtcttctgtgcggaatctgcttcctaatcagtgtagctcttgggtcagctcacagctaggacgtcatcagttctaaaggattcctcactagggagactctctccttatgggcaagggaggcagattttgacggggagaaggattcggaatatagttacataagtccccttccctctcctcaatatagtttcactcgagtcacgtcagtacctctccttttagtcgctcgtcgagacctcatcaactagttaatacctccggacctctcctttatcagtcgagtttgtgttcacaacctctcgagaaacaagttcgagagttacgtactttcaatgctctctctattccttgctaatcaaggcctgcaagggaactggctacgactataggcgggacgacatgcttttagcttccctgaaataggcgacttgctcgctttggcaggaagtattttttttgaagaattgaacaaaaaaaactgaaatttctgtaaatcattaaaacgggactttctttaaagaaaaatggtctctcaggctggttcaaagccctattttagataataggaaaaatcccatttcattcgggttttctattctgtccttatccccactgagggaagtagctaacctaacttcatattatggattagtaaggatccactgggtgggaggaatcaaactcaacgttgcgagctcaaaaagtgatcctggaaggcccacgggtaagcaaagattctaattcgagattggcagagaaacggcccgtgcgagcacgaaccaaaagaaggtgccaagccgaagtgtacaaatctcataggtctatatctgctcagtctctgttagcagcttcagtaggattctggtcttttctttctttcctgcgagtgttgaagtggggaagtccggatcaatccgtcgaaagagacgccatctctcagtctaaatggaagtagaccaagtagtttcataggaagaaatgtgaaagtaggggctgctaagcgcccagacccatgggaggtgaggtgagatagtcaatgaatggggtggtagattctggcgcagtgtcaattgagaaagcgattgtgactctgaccttcttatcggctgctggtcttgaagtctcgctaactacttggataccttctctcattcctcggaacgaaaaagcgagagtacattctcctttttagtgcatttcagctgcgtcagcagtttattctttcttattccctttcccgtgttcattttaaagtggtggataggatgaacttactggccgttggtccttctcttctctttcttattagtaatcttgttcaagtgagagggactgacatcttcttttcatttctttcatatctcccttgattctgtttcagtttgaagtaatagggaggcttgcagaccttacaattgtctttgttaaatacttttatgaccgactgacttgaatatgcttgccattggtccttatcttatctttaagataatggtaagagtggtaatgtagggctaggggtatagaatggagagcctttgtaggccgataggttgattgagtcagtacacttgacgtatgcttctagaaagaaaaagaatgagattcagctctgatcaccaccaccggatgcatttttcttgatcttctcggactctagtaaagtttatgcgttgggcctagaaagcggtaaacgtcagcaatgagtgcttcgattgtattaaattcttcttctcgattggggaaagtccgttacatgctaagacgcaccagatctatgatctctattttctacagaatcgtctagcgagaaaactctttcactaatttttcttcttggcactttcggtcttctgcagaatagtagcattgcatcgtcaattcacaattgatgtggggagagcttgttcaaagaactcgagtcaacacgccactctgcaccttgtgtgagctagacgaagaaagcacaaagtacttaccctacatatgcaggaaagaaagttaactatggataccatagctactcggggcacttggcgtcattctcacccctaatgcttctttctattcggattctatttgaaggtttttctccggattatattttttttataaaatgaaaaaaggggggctttgttccctcgtactaatagctgaacagttgtagaattaatgtggtcagcataacacaagtactcttcgcccgttgtggaatcatgcaaaaaatagacgaaaaaagacgggttttgtcaactttttgacactgtttagacatctatctaacagccagaaagataaagcagctttgataactaagaaagcagtctatgggatcctttttagcaagaatagcaattggattaggatatagatggcatgtctcattagccggcacttgctttcgattcggggaaaaactagactaatccgtataggagaagtttaagtggaagcagtggaggcagaagggcgaaaatccccaccactctccctgaaagtagctaattcaaagcagaacgagaacagatggcttgcacgctctaccttttcatctcttgcaacatctcatctgcaactatcacttatcgatttcttgcacctatatcttatgttgggtacagaaagggatcaagaatagggtggattcaccaaagggtattgacaccccagggcaaatcacacctcgacctgccttgggcaaaaaagtctccgtgcggatcacctaggggcaactcgtaccggcttctaacaagttgaagaagcactctttccttcagtcaacccatctccttcggtttagtggaaagaaaactctcctagctgagttgatgtaccgatatgaaatctcctgccccttcaacctaaggagtccggcagtacccgtctcatcaaaagccagcagtacctctttcatcaaaacaaaggccctcagaataagcgaagtaaaccgtgagttaagcgtccctcgcgtttaccgtgagaagagtttcacgcggcggctaaacgcacctatttttggcagcctattcgtagacaaagaaagccgattcgctaatccttattcctttactttgaatcaaggtcttacccgaggaagagggaagcaagcaaagcttgccccggatcgtaggggaaagagtgttgtaaccgaagtagactaccgaacgggtgtgggggagaatatcgtcaaagattgagctaatccgaatccctctcacaacaagagctaaccgtagcagtctaaggccgagatgaatcaattcgaaagctgttcttcacgtttatgatctgaaagacccggacagaagagtcatactactacggaaagggaagtgaaagcaagcctgtaaggggagggggagggcaaacttccgacatttcactgatttctccttatctttaggacattgctttacttgagggcatgctcgtgtaccatacgctttcatcgatggaagcacaacagaaggtgcttcaatctttcctatgggtattctgatgggcggggctcgggatttgatagtaagcatgaatctaaggagatcttgcagagtagtcagctggatctcgctcatgtctctatagcacctgactatgtcgcctatatttagattggctttattctctctgaaattagcagttatatcatccaccaaagatatggaggttagaaacgcaattgccctgtgataatggtgttcttccacaccaaagctcccactgcaaaagcggtaaccccatttaccaaaccatgaatgaccataagcaactccatgcaatagcctaagatccattgacctcttttgtgattcatcctccagagtgattttcctacaaaagcaacattaaaatcactcatcataagagataaaccgaacattaatcaagttaacccaaacaaaccgacaagttatcaaatatcgtcagatttcaagccaacccaaattggtttctcgcaagaaggataaacaggtctatccgatttgtttattttccatcgaattactaacctagcatcgtttttttggggtaaaacctaacttcgagttttagcaattttttagggcaaaacttaccgagtatgcaggttaacacaaaaacgatcccaaagatccataatctctctcccatgaaagtgcttggacccaccttcaatccccttcgagcaagtgaccgaacccgttcaaatggaccattccatgcaggtccgggtcagtggatctgtgccttacccgcgggggctttctcattgagtcatttccgtagtcagggagggatcgatatcttggtccatgggcccattctcaattagtcttcctggactatgtttcttacccacccgaaccatccctgctagcataaaaacaagttcgggcagtgagtcacatgttggaatgtcaggatgtggaatttttttattgagattagattagtgattaattagtcacacctaccgtaacctatattggtaaggttaagcagctgacttagcccccgtcttcttaaggaggtctttctcacaggacggagataggttatgcaattatgacttattcaagaggtcctcccttccctactggagcgctaactcctatttttttgtagagaatccttgtgtagtgtattctactggtatagaatctttgtgcgctgactcctacgaatataccgaactagtccatccattttgattgattcactgttcctcgtccaatccctctcgtatcaatccttcggatctgcctttccctgggttactttttgtagctgttgtttcatccccctatctaacgagggaattgagctggtgaatcacagcttatttctcgagtgatccctttgtaagtgtagctaaagcaggggcgatagcccctttttaaatatctttcctatctttcttacttcgtttaccagcttggaatatcactgataacccttcatatgtcattcgttgttatctgttgatttccctgtgtttgccgatcactgatgtaatggctgttccgtcctttctttcctctgagttggcttgcagaccaaggaggatcaacgtctcattgtattccagttagtttcacagctaccccttcccctacatcttctttcttcttctctgtatctttcgctgttggccagcttgaatcgtagttttctcttatgggaagggcggacgaagccactttcactttggcaaacaggaaccagccaagtaaaaaagaaaggtgatgggaaatttccaattagatcgagattcttctttcttcttatggatagaggttaggttatctttgccagctcgatgccacaaaggtttaaaatggggattccttggtgccgttcgcttgacttgaggtcagtcctttcaactagcctagacccatcatatggggagctttaaatggtgcctagcctttcgaaaggaagcctgtctgtctgttagtatggactatagaatagaattcttttatcactgctaagcaataagtctcagctagggcacaggagaactgaggtcgggggggggggggggtgaaataatatagattagcaaactcgttcgattccagattggcgagtcagggggatcttattaccaaggatcgatcagggataaagaaaaaaaaagggttccggccgggctaaaggtttcaaatcaaggtgtaggtgggcatatccatgtttgggcatttcacatgatgagtagagcgataggtcttcctcttgcaatcgagagaggcaaataggcggaaatcggtacacttttagtacggtggtatgcgagcagcaaaacagtatatgcaatacagaaatacgagcaagctcactaatcatagtacggtaaataagcacaagcagcagcaaggaaagaaagccagctagcccttatagtgcccgaagcgagatcggagtaggaagaccatgagcggaaaggaagaaagcttcaatgccaagagcagataggataagagctgctacggtgggggaacctcacccagtcaatcctaggagtaagcccttttactaagaagtagaagttcacatgcccatcttttctcttgcatgcgccttcgttcctcattaattcaaatcaaagtaagcgacatcgcatcgggaagggatagggatagcgcatttgcttggttggcggctggctagcttagctctcgtcttgtagctgctgcttatcgaccggcagaccggctaccagcagcaagaattgaatcttttgagccttaagttcttcttgccccagtttcactatctctttcacttcttcgattccccttgaagtagggggtttcagtgggaacgagatcaatcaatgaagggtcaagagaaagaagaaaagaagactaatctggatattcccgaagatgcttgacttcgagttcttggagtgacagctttgtaaacaagggtcccttacttttgagtttcgaaaatgcatctttctttctcccatgcttttcattggtcaacaaccaaaccaaccactaattcttccttcactactaatccaggaagaagtcttgtcttcttctgttcggaatacatttttttcaaaagaaagactcaaaaataatataaataataatatatagaatatagaaagaattgcttaaataactcagcgatctaaaatcatagtcacgatctactaaaagtaaagttgagcacccggaccagacagaggtggccgagaatcttatgtcaaaaggaccaaggatgatcttttcggaaaggaggagtaggaggagtcagacggaatcaaatgattacgagatagacaatgagaccagggagagcaagagcacttagacaattcactttgagtacaggaaagtctgctggtaggaattcctcagggcgtattacggtttttcaccgagggggtggctcgaagcgattgctgcgaagaattgatctgaaacgaagcacttcctctatgggcattgtagagagtatagaatatgaccctaatcgttcttctcagatcgctccagtacgatggatcaaagggggctgccagaaaaaaatgaacacgatcgagaagttcgctccgccgcgcaagatcctcgaacctaccacgaacaccatcagcggcctcttttcgttctctttcctgcccgggaaggtggataaaagaaaggtagcttgcttctctcctggactgatggccgcttatgtagtggtcggccttcctaccggaatgcctcctttgtcttcgtctaagagcgcctttgctagtaagggcgcaggaagcacaaaaactttagtgaaggacgtcttcttctctgccttctcctctttaaaggccaagagagagactgcatcccttgccttcgctagctcttttggtttcccaaggatagcggtagctggggcaaagcccgctttcttcgctccgcgaatgagacagaaagtgagaggaaaaagcacgttctctctttgcgaggtccaaaaggggagaacgcatagcattctctgggcacataggatcaaaggtaaagcagggctttcttggcagagttttaggcggcaagatactttagggcttgttggagctgctgggcataaaaaatcgaagccgaagacagatcaaggtaacttgcctgccaagccaataggcgaaagggcgaagcaactcaaagctctccggggtttgagggcgaaggatggagcgtgcaaagtcgatcgtgcacctgtcgtgtgacccgttggtcctaagcaatgtcttgcgcgaagcgacccacctagaaagagctctcctttatctgggggcactaaaatgaaacttcgatcagatgcgggtataaaatcccgccgctgagatgtccagcggattcctgagccttgacgaaaggtcggccaccttttttttacggagagcaaaaggcccggggcatagcaggatgaaccaatgtgaatgagtgtaagcttcgttgcccgaacacgattggtgctgaccacactaggtgctaccgcggtagcaagagaggccaggcaatgacaattgagaggttgtcactgaacatttctagtcacacgggaagagaggtccaatggcaaggccatacgcccgtttggctcctcgcggagtatagctcacatccaaatatcatatctgattggggaacggggtaacacccatgaagctccgacggaaagggaaggcctgccaggccgtatgcccatgggtgcaggattcttcgaaaaagcgcgggctgactcggagacctgggaccttggcttagcaacgaatgaatatttctcctcgagctttctccgccagcggcttatgtagtgatcggccagctcgctaagcttcgcttccctttcccctttactttatttaataagggaagggggaaagtcttcacttagtagtcggcattatagaagcggtttgtcgagtctacgaagctttccttcttgtagtcggcccgtaatgcctcccttcatttgcttgcctccttccttacttttcagagaagcattttacgactataaggggcgctgttcacctttggaaacttagctacaccggtcacgatatcttgttgatattgattgaggactttcgctgactaaatccataaacctagaaagtcaccgtcactggtacttttttgactcgataggtaggtattggtggagcttgcgtaatgtagttgtagttaaggttgcattgaagtctttcttttttttgaagatctactgaacaaaggcgaacggggttcccaaggcgggacgtctggcagaatgcttggcctcccgcgctggaagcgagacccgaagggtgagcttctggcggttagcttctagaacttataataggcattaggcattctgagctggaaggaggcaagcaaaaggccgaccactctatcatttcccatttctgatgggaaggccgaccactacacggactctataacaagtcatgagcgatatcgaaaccaagccaaagcctataggctttgggatgaaagccagcccgacgaaggcctatgatagagtaagaaaaaaagtacgttaaagtgacgaagtaacttagccgtctacaaagggaaaggcgtcggtacggagtcaccgtcagctgtggatatagactatactataaggaacggagtcttaaactatggaccgagactacactaaggaacaaggaagcttgactgagcaaagaagtcaaggaacgaagctgcttctctaatagccccgttgaataggagggcgaaggctttaaaaaaaagtttgatttagggagagggggcttcaagttcttaggaagagccgtacgaggcagctcacgtacggttcgggagccgagcccctgcacaggggcttaggtcaacacttatataatagccagtcatcaattagaagcaggcaaaatggtgatgaattgcgattggtccaaaccttcgaccagctccttcttgcaatccgcccagaatgaccatcctaagcccttattcactgtgtgaagaacggggcagtccgctggagtgtaggcttcttggccacgccccctgcttatagatacgaaatacttgagataaattatcaaataggaaattgcataccattagccgatatacgtttaggaacatgggtacatgaaccctataaaatccttcacttttagctttgaattacttatatatatcctatgaatttaatttcgcatcggaaacgattctaggagaagttcgaatccgttccgttcggatattgatcggtcttggtttgacatggtttacgtgttactggttcccggaagagttaatatctccattagcgtcaccctttcttaccctgccttttgactcgtattttgtttgtacacaattaacggaggccttttcgacatttgttgcaacgtcttcaatagcatgctcttatttcgtctttcctttaataagttatcaaatttggtgctttttgatccccagttgctatggagaacaaaggacgaaatacaatcgattcctccatttaagtggttctcgcttcttcttgttcctgttcctaactcctccccgggtcgttcccaatgtttggcactttccatacttcgtgggtgcaacatcaacaaattcgctcatgatcaagttacaacctaagatctatgaccatattatgttaactgttcgtatttcgttcattccatcggtatgctcccaggtacctgtaattgtgatctgtttgccagaaccaaggggtctttctttggaaaccttcacgaacaatcgtcgttttttgatggtttttccgcttctcacagctgctctttccacacctccggatatctggtgccaaatcgtcgcccgtttccttatttctttgataatagagttggctatttttgtggcatcgattgtacaagttcgtgaagagggctggacgagtggaatgagggagagcggctcgatcgagaaaaaaaataagagtagcccccccccctagaacctggcaaagtaactatcaatgaattccaataaagattataacacacagaggactccttaccagcgggatgagtgatacattcggtgagcgccgtagttaagttttccttattcgttagctatgctaaaggaatggattgttctctttagggagtgcagaatcaactagggttaacctctctttagcctatctgtcctcatgctagtcaatctcaggtaattggtctatggcaaaggggttcctctttccttcacctgatggcaaatacaagaagagttcggcaacgcaaaagcgggcttaataatcaaataataagatcgagttaagagaactcgtcccctaaactatctagttaacggcggcgtgatcttgctgtagggtcagagctgcaccgaagaacagttattatcgactcgatggctctgatccgcgtgaatcagacggtgagttactggttcttgaatgggaatcccgagcaccaaagagcagagtgatcctctgctcgagataggaccgggtaaagggaaaaagacagaaaagaccatagaatagcaataggaatcgctgctatccgacaactttctccgtggagcccgcagctaaaggttaacaaaagattgtagaacccatggacttactatctaaacgatacgagacgggtcagtcaagggccaccagaggcacaaagctggcgaatatccgtgagagcggaagatataaaaggtataggtaagtaagctcttttaagatcaagggcaataagacgtcgaaggaagaatccgcaatgctttgacattccttttcaaatgagttgtgcccagcccagttagtccactactacagatagtaactagcacagaaaaacaagatggaatcaaatacggtgttaattaatttactgaagtgaagcaaggaacgtagtaactcgactggttggagagaaactttgttattagggttgaatttccagtcttcgggcctcaacaccggagcttatcctgaggcctaggtaggtaggtagtgacgtctcttgctgggtctttcataaggaatggtcctgttagtcttaatccagcgactggccttgctccgagccgatatccgaagtatggttcgctcgctagttatatgcttaacacatgcatctgaggtcagaggtgccgctaaggtgaacgctcagcttcaactctgactatatattatatataagtgcactgaaggttaactatgtcaatctacaactcaatgtgattggcttcgcccgggctcagtctctttcggccggtatgtagaatcgtcggagcgagcaaagcagcggagcgaagtgggctgtgtaatcattttattttttgacttttttttaatatataagggtaagtaaggagctgaaaacgagtccttcggagggcgaagaaactcattaattcattttgatgagggcccctcattcaaatgttatgcttagtgcttccctcacattttgagttgattatttccaatttcgagagtgagattgatccgaccaagtagtagtgcggaagccagtacatacatggctagtttccaggcaagccatccatattggcataaccttcttctatgccatctagcttcatagccgatagtttccgttgatcattatcttcatccatcggatcagctccttcttttctgatttttttcaatgactgcttcttatgcttgccctcgttcttctctcttctcctagacccaccccccttactgtctgtttaggccccctgccaggtactccagtctcattgcgtaccgtcgtctgcatcttcttgccctgttttcatagttgtttgcttttcttatatggattaggcttggttaaaagcgtaccgtcaagcaagaaaaggaaccgtaaactagctttaccgagttggcttcttcgtatgagccctagcagcatctattccttactctgttttctgctttcaagcccctaagtaggatcgtctaacgaagtcaggtacgagggaatatgttaatgcaaaagaggcgaggaggctggtgaccagagaaggtctgtgatggaagcaattcctggctttctggtctgtgataaaagcaatctctctccggtcggttcgactgttaatggaaaaatgaatagatccttaggaagaaaaaggctcttttgctcttgtgtagaatcagttgttacagagaaggagcggttttcgtttcgcaatggaatcagaattagctacgatcaattaaaatatcgtagtatagtaagagccaacgaagtagttgtaacgtgaacagctaaagctccttaccttatatgggctgcaccgcgctgaatgatcaaatcccatttattcttatttttttacattacaactcccatgcctttccgttggtcaacaaccaaccgtcgatttaccttttccttcattttgagaacaagtctctcttggggggagcagagcatgcaaaatcgagcaatagatggatcttagaagaattccactttgaacggcacgactctttcgatttttgcgctggcatttgagttgtctcccctcctctttcaatcgacacactcgacgcagatagctccggtggccccggcttctgcctctatcaggcttaggctgcccccacccccacagagccacagcatggagtagctgctcccgcgctacaaccaatcaaaattttatacggatcgatatatgatgatgctaaaccgagatagagaaagagggcgaagaaactcattaattcatcgatgagggttgccgcgcctccctttgttggctcttcgagacaaaaacactcataggaatggtgctaattcccatgttccttctagtctcgtttggtttcgaaagcctccccctccctgtctcttactctttgaaagctgtcatcctggatttatttttgaatggtttctttgttctcttatttggattgaaagaaagacaaaacttcattttcttcgacgaatttcggctatgaccaatgcaccaatagctgaataggcgtaacaaagctacctgaaaaggcaaggtgcaccttgggattgaaatcgacgaattgcgttttgcccgagagatttatttagaaagattatccatcggataaagaatgcaaaaatagaaagaatataaataaaggcgtatacacgggaagggggcaccactacttccagggggagactagcctcattacttcttagtgggcgagaggtgcgcctaacccacctacccactcataaatcacggtgttcagctgacttgaactgatagacccttattgtattggaatttagcgcccatcttttgactgttgtcaacaaatctcttcaatgttcgattctactctatgttagaacatttctgtgaatgctattctaatctaagtggtcttattctgtgtcctgtgctaggaagcattactcttcttttcattccaaattcaagaatacgaccgatacgattaattggtctgtgtgcctctcttattacttttttgtattctcctgttcctcggatacaattcgactcttctacggccaaatctcaatttgtggaaagccttcgatggcttccttatgaaaacatcaatttttatttgggtatagacggtatctctttattcttcgtgatattgaccacatttctgatccctatttgcatttcagtgggttggtctggtatgagaagttatgggaaagagtatattacagcatttttaattcgtgaatttctaatgatcgccgtgttccgcatgctagatcttctactattctatgtttttcccgaaagcgtgccaatccctatgttgtgcggagcggagtatcttatattcgctgggagaaagcttttcctctgcaggggccttgtgcagtaaaccccctacgggcggtcgtccgtcgtcgtaaagtagtccccgcgaagctttcgggaagaggggtagtcttgtgtgtaagcatagcatttctggtcgaacccgcccaatccaactaagaagaaccgaacctgacaaacacatctttttccttttgggagggtactccgagtatagtgggtacctcgtaggacctcgacccgcctactcgggtcttgtatggatatgcaggaaggggtgctcctaggtgtgtgtaggggttgtgtttgttcgcgagaatggattcctcgtcaagtctgtttggggggtgtggacacacttgcgcgaattcaggtaacggctacaagggagaaataaaaaggaaactgtacccgaccagggatggacgtaaactcgtaagctaccgaggttagggataatcgtccaggtcttggcgaggtacttttgtcactcgactgaaaggagaggagaccttaggataagttgctaaaacaaaggggagtagaggatcgacccgttcagtagaattccgaagaaagactgttgacagctggtggagacatttctttggcccccggcaaatcaaaaggaaatgcgggcaggtttaagctcggcagagggttcaagaatagggtcctgcccttcagattctcagaataaaaaaatagttccaaacctttatgcatgcacctccgtataagtgctgcgtacaagttccggccaggataattgggaaagatcaaacccgaaagaaccgctcacatcacagtagtagtagcgtaaaggccgtaagtcgggtagcggccataccataaggtaaggggctattactttcacatctctccttctgtcgtactataagaaagagagatccgctgcgtgagcaacccgactgtgcgttacatgtgctctacaggccgaactccatctttcttcttaacaagcccatttatctttagattttgaagacgggcgttgcgttcggttcgaaaggtatggttttcagtatgtctccagatagggcgccccactagtccggctagctagtgagcggttctttcgggcgagaagcaggccgggccctacgggcgggggcatctcccgcaacgaaagctgcatagttcgccaccacccgaaaagtaaaagattagagagtccagactaaaaatacatgcatagatagtgatctaatgacaagggccgacgacggaagctcgggacggagccgtatgatgcggaagtctcacgtacggttccctgagaagggagtggctacctactggagcttcgaccaagcacccccggtcaattccgctttggggccaccccttactctaccattattataggagtatggggttcgagacaaagaaagatcaaggcagcatatcagtttttcctttatactttacttggatctctttttatgctattagctattctgttgattcttttccaaacaggaaccaccgatttacaaatatcattaaccacagaatttagtgagcggcgccaaatctttctatggattgcttctttcgcctctttcgccgtcaaagtgcctatggtaccagttcatatttggttacctgaagctcatgtagaggcacctacggcaggatccgtcatcttggcaggaattcctttaaaatttggaacccacgggtttttaagattttcaatacccatgtttcccgaagcgacactttgttctactcctttcatttatactttaagcgcgattgctataatatatacttccttgaccacttcaagacagatcgatctaaagaagatcattgcttactcctcagtagcccatatgaatctggtgactattggtatgtttagtcgggcggcggccgttaggtcacctattttgagttatggacacacaaggccaaaacatgtgtgtcgggcgtgcgacccatcaacctactagcaatgggggagaaaacatagcatgtcgcaacaaaagcttgattcgaggcgtcagcaaaacactgccgtctgttcccttcagtcccttagcgccccgggacgggagtgggggacggctctacgcgcaggcaacagcagcaccggctccacgaagtctgaatcgaatctttctgttggctttcccaaattcattcgtagatcaaaatcaaagggctagaagcgagcgcttctagctgcttcgcctgcttcttcttattatggcggccatgttggcgtggcgaaaatgaacgaaaagcgagatgaacgtgctattttcaaatcggattgatagattgatctgttctgatagatctaaagagtagaaatagatagagaatagagagggaatcaataataaggtctttgagcctatttctatctattgatgagacaactatctattcttgatccatcagaaagaaattatttatccatcagaaagaaatcgatatgtatctgatggagtcttctacatcgtacgtagagcgcccaagcgctttttgggccagctcagttctcttatccatcggtccaatgcactgggctcatctcatggagggaaaagccaaaatgtagttgtcttgttgttgttcgccgcctcgacgcattcccttctctccccggcatcgtcccacacagaaagaaagagcgcggagccccggctcgagccgtaggtccgctaacgtaaagcgaggagttgagcctgaactggcgaaccgaagtcactttcggaaccatacttcctacagctgctaacatgtgcccagtcctgcggaaaggcgcaaacgaacgtgagctgctataccggaatcccccgctggccatcggggaccgagtggtaaggccatgatctgcaggggaacggatcactcattcttccattggggacaggtgcacgaacgacaactccaaacgtcacacatccgccgcctacttaccgtttaggtggcaccagcgagatccagctaaggaaaaagagtgtcgcggctgctccactccgccgcggtctcatgaacttcacttcgttgccttcccgcgcgcaaagcgaatgggcgctgtgctgtgggtcagtttcggggcggggggcgcagagataccagaataaatgattcatttgtttggatcgacgagctttttcagccccaaaactcagaatcaatggaatgtctgtccataaacatctattctatctgtatatataggggatctctctatacatatcaaagtcttttatggcattgatatgatcgcctagctgtagccgcatatcacagctgcactcaatatgcggatttctgttggattagatcttttctttcgctttgacggaagctttttgacctagcgaaaagcactttcgcgcaagcaaagtagaagctttgccagaagcaagacgaggaagtggagctgtcgtataagcggtagcttcccccgaccgactaaaatacaagagtcgcggcctactttgattgcgaaggggtttggcaacaagcaaacggctttctatcatagttgcaagggttcaaaaccttagttcgctgcttttcccagtactagagaagggcttatactgctcgcctttgtttggtttgatatattcattcagtcaaaatacaaactacaacaaagtggaagtggaagggccgctatagaagctagaacttgctttataagtcggcctaaccaaagcgtcacgacaacaaaaaattatccttatgaatggaatcttaagtagggggggctttgaccgcccgcctaccaatcaaagaggcagagagtaaacgtaagctcacccgtaagctcgaagagagcttcccttcattcgcttcgcgggagccgcacaagcacatagctggaagtcagagggcccatactacctgcctaaccctttgttccgagggaccgtagatcggaaagcaccccatttatccaaaagagaagggaaggggcctatgtatttgcatgacccctgcggatttgaccctatcccggagccaatcccctattggtcctgccaccacgccgcagaacgagagctcgtgtggaaccttttctttctggcgtaacagccggtggaacgtaacaaaagattacggtcgcctaacattaacataagggcggggggtacggtaaactcggccaaaatatgacacccgaagggcccgaacgcacaatcctatcccatccgagtccgagtttaccccttgcacttcggacagccgaccgtagcatcataaggaggaccccctttcgaggtaaaaaaaaaaaaaggtacggtacatataggaggttggactttctcaacgtggtgtatagcacgaaaaacttttcgatacaagaaagggccgttctcacatgaaagaagagaagaaatcctttcttctcttctttctctttctcgagaaggaaagaaagaggatggggggagggggggaatggggccggtgcccttcttttacggccgtcactcttatttgtcagccgtgaggaactaccggctcggtctcggtgggaaaggaaaggcttgggcctacctatcccgataagacctcataaaggaacggcgggagtgataggttccatattgccgagctgaagggcaagacttttgtacgtgatcgtagtatgtgacgtcgtctcgtccacgctgcattgaagagtacctacgcactaagttccggttcactgataaggaagatagagttgggcgggggtctacgatgtgatactcaagtatatgacccggggagatacatgctaactatgggtaggaagcaggaacccttatgtaaataatttcgggggggggttacagatctcttatactaccatcgatcgacagagtggaacgaccagaaaaataagtgatgttagaaagccgtatgataggtggtaactatcttgtacggttcggggggtaatcggcgtactccgggagaaatctttcgctctatcgaacatacagggaattggaggtagcattctaccgatgttaagtcatggactggttccttcagccctttttctatgtgttggtgttttatatgaccgacataagactcgacttgttagatattacggaggtttagtgagcaccatgccgaatctctctaccattttcttttcttttactttggccaatatgagttcacctggtactagcagctttatcggggaatttctcatcttagtaggagctttccaaagaaatagcttagtagccacattagcagcgcttgggatgattttaggtgcggcctattccctttggctatataatcgtgtggtttctggaaatttaaaacctgatttcctccataaattctccgattcaaatggcagagaagtttccatatttataccttttcttgttggaggggcgaccgtccgttgaactaccaaagaaaaagggtaaacctatgtgatcatgacattgtaggtgcttgcgatgggacggatgcgacttccctcagttggtttgggtggcatagcccgttgcataagtccccctttttttgattcattttttgagtctttagggagccaaagctttactttactaataaaggctcgcgcaggggcgctcacttttttttgctaagccgtctctttctgggtgggaccgagagaaataaaggacagagggcaaccatgcatggtacttctcgaccctgtctccgagggacagttgaacgagcgactcatgaatgctgccgggtcggacgagccaataactcgaacgcgttcggtctgttttttgagcaagaatcacagcgttaccttaccttcaccatgatacggactccaagttcttatggcagagcacgaggagatttatcatcaatattctaatgggaatggaaaccagaagcacgaccgaggtcttcgtagtctaaaataataaaaccatcaataacagtaatgtaagcatgagactttttggtagtacctgtgaaccagatggccgcggcgatggaatctgggacggaggactcgtagtatctctctagatccggcaaaagcgaaagaccccctagttccattcgaatgaaggctgactgctgagcccactctggccccggcgggcccccgtggttgcgagccggagctgccatagcttatggctagagcaatgggaggggcctcagcagagagaacagaacagaaccaccgtaaggataacgagtgctccgcccgtcaagcgggcggcaggagcagcaggcaagtacttggtaggccaacagtccagtgggcactcgacgaaagggggcacacggagcaagtacgagaaattggccccgctccgctttataaaaagcaaggacccactacgggaggtcaaaaacccaggacctatggaagtcggggctcgtccccggtcaatattggatcaaacaaaacaagcaataggggcccgtagcactgacctctttttttattgattcaatataataggggaaaagatcgtacagttccctaccgagacaagagacactcttaacagatcctccgcgcgctgggcatacctcttccgtgcgtctttctcgtggcaggaacagaacaacagggaaagaaagacccggggccgacctgcccagggctcgagggcgagctttatttaagagagaatggggagcgaatcgaaaggcttccgttttagttcttggtttggttcgggctcctctcgatctttttcgtagtagggaagggggaaggagtctaaatctatggacattaatgaaccatcattgatggacgttgcacatgacacgatcaattcgactcagggtccggcgctaatagaggttgcttactttcctagtagcgaaggaaaagggcagggcttttttcgtggtaatagtgggcgggtctcctttcgaagtaaaggccttcgcattcctaatccgccccaccaaccccggacggcttagtttgtcccagcttggtgaatcgcatccccgcgcaacgacatagtttgtgcgccctttaccgttctcgctcagtgtttgcaacggctggggaggcagtcgtagaagcgaagtctatcgccacgccaaccatcaaatacgagattgggccccttctcaaagatttgatggaatggcccacccaatagcgcttatgtcatatgggaactcatggctggaaacaatccttatggttttgatatccggtaggaataataagaatcaaagtccaggtaggttggtgagcctagtgataggagactatctagcttggttcggagagcacttgttgggttaaaaactttttttgttgctaaatgttacagcctaaatgctgaactattgactctactcgttcggatgggtgttcaccccaaagtgttcccggactgcatgcatacatccgtaagtaacttagtgcaacatggcaaatttcattgagaggaatcagcaaagaaaagaaaaacgggtcaacatcttaatgtgtatttgaggatattttagggccctagaacgcaaaaaaaaggtgggtgaacaagagttgtcacgataggaaagagaaatgactataaggaaccaacggttctctcttcttaaacaacctatatcctccacacttaatcagcatttagtagattatccaaccccgagcaatcttagttattggtgggggttcggtccgttagctggtaccatgatactttctgttttgtcgagccctgctttggtctctggtttgatggttgcacgtgctaaaaatctggtacattccgttttgtttcccatccctatctttttttctatcaatcaacttttccattacttttgtaggcttcctattataaagcacctggcaacaaaatgccaactccttctttttttgatttctcactttctgcttttgctggttcttaccaaattggtacttgatctgggcggctatctctttatggacgacctgagtcgtgccctttctcaattcgtccccggtttttccgggggattgggagggggttctaatacgccgcccaacccctcaggggatttttttctctcttcttatcaaacttcagacccggactatcacgatcagcggaggggtgattcctacttttcctccgcgcccggagtacaggaaacccaccggcacgcgtcgggaagttccacaaaccttcacttgaacctaaacgaccaaagccaagatcccatttttttagaggttgagcgcctaagcttgaaatgcgataaagtgaaagaaaaaacgatattaaagacccagtctttattgctagaaagaggttaccatattccggatgaacgggatatagaacgagcaataaatgttgtgatgactgaacatgaaacgatcgatatagatcggcgtaggaaacggttctactacctttactcgtgtttaggaaaaaccggaaacaagttttggatggagctactggaaacgctggctgactacaatataaatataaaaagcgattccgacaactaacctgccatttcaggttttttgttaggtctcgactttcttttcaggcttgactcattattttgctaggtataggtcctctccttcaaatactggaaggtggatcacttgtaggaattgtaggaatgacataatgctaatccatgttgtacatggccaaggaagcataaaatgattctttcattctatagatacctctggtaggtaaagcactcgactgtgctttattgaaagttcccatcgcgggggcgaggatacttgccttcgcggttcgactttcttttcaggcttgactcattcgctagcttctcctcccctttagagctctttatgatgcccactgagtaagattcggggacttccggcgcagaagctcattctgaaccgcgggaaccttcgtctcaatcttcataatcaatttatgcacttttttcttatgtgatttcatagttcgaggcgcttaatgaagaagcagctatagttcctctcgggctagaatgactgacttggctttcgactgatatagtgcatgggtctgtacttcaggctgaggttcttggattgaaatcttatgatgttctgactgaccttttccctcctcgacttgagtagatagtcagggtttcagaatatgtttgttggatgggaatatggtgcttgatggtgttgttgttcagacctcggctttctcccttcctttcgtatatgccatgccagctgacagggagatcttcgttgttcagcttatattagagtcgttctaccttctatgggtccaagggaaatggggcagttgttccatcttcccatgcctggactaccgatagttccctcttcttcctcttattgtttccctctttcgtacgtacacacgtcgtcaagggattgatgctaaacaaccaaagctgccttggctgctgtgactgcctctccttgcctcctatcctttaagtcgagtacttcgttccttttcagtcgagttatcgctttcgcttcttttgatcctgcagaggcaggacaaactcccggcgagcaaggtcaagatgccgatgctgtcggtctgcagcctcctttagtcaacgaagcgaactggctgaactctatgtcttttggcttcgtcttgctgaaagaaaaagagtgaggaaaacaaagcaacaaaagagagtggcaacaagaagaatggaaggcttcccgttactgaagtgaacttctcggtaagtccggcactctgccccatataccttattcgtagtatcgctcctatctcgatgaagcttctagcctacaccggggttcctctcgatacatcttgcaagggatttctagttgactgttgcctctccttctccaccaccgaatccttaccctcctcttctctccggctagacatctgctttggcttcaccggctgactcggatgtaagcgatgaactagtctctcctacagttaatcatttctatggtgtgggtagcgaggttcttcttctccattgaagaaatgagcagccttgagacccaggagaatagcttcaacatagccttcaccatctgacccggagcccttgccgttcacttcactactacgtacgccaggatctagcccttagctgcagagattcggataaagctctgtgctctctccaacagcgtattatcccgtagctaccgctctttcctgccacttcaaagtggaattctttctctgtgttgctttgcgaattgggattgagtctcagccaagaaagataaggtgatcgaaaggtcaaatcagagatctcctcgcttacccctgaaggagctgatcgaggaccaatgtcagaacactcgagttggccttccttccctacggatgaggagattcaacagattatggtttagaagccgaacaaagagcattggtgtgaccgttagcagcccagtcgtgccctcccctgaacactcggacgagagggtgagggtgggtgcctctctatgattcgtctatctatgttcctatctatcggaatgactcccaccgctgcttcaatctatatctcccggtaaagtgaaatcatcaatctgaatcaattgaatccttcgatatcagtgaaatcctccatctatgattgctccttcatttcctcaatcggaagagtcttcttctcttctgtcagttgatcagcatcccttttccaagaacacctcgaattcggcctactctacttcccggaatgagacgggggtcgagtcataggagctgcttctctctgctattggacttgcaacagcggtctctctataggaaagagatagctcgttcactccgtctctctctgctttgccgaccagaaactttccgtatcgtacttaagagcccgaaagcacactcctctgctttgattccaggttagggataagaactcttcactgttgaatagagagattcaattgctagtaagttattcaatcgatacttctgggcctgcctacgctgatgaatccctcctttcttcaggtagcatgagaagatggaatctcagacttgcaaagcagacctacgactcaggtctcgaagagccttgccatagcgtacagagaaagcaagaggaccggtagctctagagtccagggggtcttcacctttacttatagtcgagtgggcagcgttgacggaaggagagtcaggtattcacttagttgacgctatcgtccttctaatccatctttccgtttagctcggcattgctattgatctctatctctgctgaagcatgttattgatcgggaatcgttccttgaccatattggtcttatccatcctcctctaacccctaccaacttcgatagcgatcactaaggcaacctacatcctctatcccttagcctctctcaatgtatgcaagagtctccctgcgaggagaaggaaggcaaacaacagaaaggagagggcaccagcaagtgaaacacacatggaagtcagtctagcaatctatcccagccaagaagccgttaaaaagaagtcaggatacccgaggtaagccaaccaagccaatgatccaaccaagccaatgatgtggtttgatgcatcgatcttcttccgaacaaggtagccaaccaagaaagtatctgatcacccatccgatacgaagacctttgatagtcaacctctccagcttgatagtccctctccagtcaataaagaaccttcccttgcgaaataaccttcccttgccaggcagttggctttgttccttggtaaagaagagaaagctaacgggtaagcggatggcaaagaagagaaagctagcctttgcttgggtgaagatgtgaaagaggagaaatccaaagaaagaagagaaagctgctatagtttaagctaactcctccgacagcgaaaagaaagaggagaaagctgccagtactcactcagccgaggatccttacttcctttcatagacgaaacggggcttgaatcggtatattggttgagaatgactccctgcttcattaatgggaaatgcgcggagcaactaactagtaccactgcatacaagcttctcttccttcctccgttaacagaacatacgacttctctgtatccaaagcagtaccccgataaacaactagtacttttactagaccccaggagcggaactcgattaacatactacagccagcccttcttcattgccctctcttccccatattctgggtcctctttgtctgctaagttccactttgctcctcatctctatgcattcttggtggttgctagcataaccagatctgacatagcttactcagtgaactgactttctgatcgaagagagatcagaaggtttaccagtttatattccttcctagaaaacgctttctctgttgagatatcttctctcgacctctctccttgcgtagtagctgagtcatcagtttatcttgtagtgagggattcacctctggcttattcttcgtgtcaggcttgttagaccacttcttgtcttcctagtattcttgctgcttttacttattctgagtgagagctcagtcttatcttcttagccttctatccgcatacttccaacacaaagagaaagaaggtaaatggcctctggagaggtaagatttgtagggaaaggtaagccaatacatcaaatttctcactcacaactggcatgctaccagcaagaatagaatcttccattttcggtgaatgctctctcttcaacaacaggagttctaaataaagtaacgaaggagagctgcggaaccgctagcagcacttgccaacacttgtcagcagccaaggggtcctcttcttgccagccaatgactaacagatagatgtttgggattcagacttgtatgcatcgggggaaacatgggctccgcctaaggttcgaggaattcctttgacctagtttgctgcgtttccgttcttgcttgctcgacttatgactcacaactggtggagctttgcccttggcttgctgtaaagagcttggccaaataggatggttcctcactctttaggggaaggaacggtgcttctcaaagtaggattggagaagtctccccctaacaggaaatgtacacaacgctgtttgtgggacgggaacttcctggtgatttgactttgtcgaagtctctctagtgcttccgatgtgataatgttaagcatatagctagtaacgcctttgaagcaaggttgccaccgaagttcatcaaaaaaagacggggtattgcaacttttgaaggcttttcggctctctaaaataagatcagatactatacgaaattagccttttcgaggacccaaaaatgggtctttctttactgattcattaaaaaaccacggctctttaaaaaaagaaagagttgaaaaagctgattgcatagccgttttattcacgtcgggcattcactttagcagctttagcgagtaaaggcatatagctagtatagcagttgagtcggtgaactcggataagtaagcttacagtatccgttatcttattccttagggcaggcctctatcttgttccaatcccagtagcaaaacgcgggctaggagtggcttgttcctcactcgggggactgcttgatccgctcctcccgtctatatttcttaccttgtcgcttcccgttctccatcgtactgatatgactgctatggtaggagaatctcaagtgcttgcgataaaggtcggccccttccaagtcggaccttggcttgtagcctggacttctcatttgatgaggaggaaaaggggcatgtaagtgtaaggatgaaacctcgggtaggtgagattggagcctattattgtatgcgtgatggaattccgatcttccctctcttcctctggagcccttacctcgcaggggcctgactttggggtgtggttcttggcctgtattatttgtccgatcgcattatcttttattccggttcatcatagtctcgtatctctcaaccatctatatcataagagaagccggttccaagactagtcgagatgccctattcagaaaggtagatgagagcttgcggagaaggaaagttttcatggttggctgatccatcgaatactgtcctttcccctttttaccattttttcgtcgagttgctgatacgttcttctccagcaacagcctacgtagcaatcttcctcttttcaaggacaaggaagaaagcatcagacacgtccgtagttctaggtctttttgcccagttcctggagcactcttgtggtttagtgtgctaagtaatctgggagcccactgtcattttattcgggctcagctcaatcggcatcgaaactcttaattctattatgacccttcgccatctcctccctgtcgattctcattaaaaattaagagcaggagacccacaagtagtaaaagcaagtctagaccttttagccatttcaagagaggtagaccctccagcgcaggaagttcttctaaaaagaagaagagtgcactgaagaggataggaatcagggcctgtactgtattgggagtgagttgaaatatcttttgtataagacatataaaacaaatcccaccgatcagaaataaaaggaagaccatcccttcgatcggtattcccgctttgcccgccgcggacgagagccaaacggatacaaaaagggcgagaaccgaataaagtataaaggtcagcatatatcctgttagcgtgcgtttctccagggaaataaaaagaacgcacgatcccgagaatatagcggctagttgccaggggtctaagaaagagatctcctgaaaagcgtataaccttagtccatataacatgagacaaagcaaaatgagaggtagaattccccctcgtagagctacaggggattctcttcttcctagacagaatgaaagcgcggagtatcctaaaagctgcgaagctaataggaacccccactccgcgagttctctatctagtccaaagaacagtaaaaaaataaaaggcgacaagggaggggaaccccaagaccagaacaccggagaaaatgccaagcaaccctacttgggcgaaagccaaccctcttaaaaaaagggtggaaagttggcatagggcgaatagtcctaggagatatggccttagtctcggatctatagaaagtgtgcagtgagagatctttataggtagagttaagtaaagccagtctttacttaactcggcccaaacaattttgattattcaatataaaactgtcccatgctttccgttggtcaacaaccaaccaaaccacatattttcgtctttccaaattaggagagcaaataagcaagtcctttccaactagagctcctggcggtcttttaagctgttcaactagttagggcattagcctcagaggcaggggtttgaagtcaggaatttcccactcccactggacgacatgcggatagagaaatgcgactaagctagattcaggaacagcttctattagtacacaatctttttgaatatagatcagcagcggatgttgcgacagtaacttcaacatcgacaacagccttcagtcgtcgaagtaaggaattactaggaactgctttcattcccacgatatgcgccaacagggcttttaggaagagtagtaacagcaccagtaaccgctttctttattccggactttcagtaaggaatgatagaacagctgatacaaagatagtgagaagagctgatatgcttaagcgtcgaaaggactgtttgcttacgtgccggattgcttttctaactagccagtatagttacagctgatatttctatatgaaagaaagctttaataatagatgcgattgtgagcaggcttacttatcagtgctagcttgtatgcgctttctattacagcaacagcttttatgcgaaaaacaagaaaaaggaaaactgcagctctgcgacataaccagtcttgcagaactggaagaacgaatttactcgacaaggaaaccaagtcaaaaggttgcgcctgacagccaagcgccagtttttgtaatctctttccttccaaggagtccttgtcttcttgcatcacggcctcgatctacgcaatgaaaacgtatttcctctaactgcccgtaaagtcagaattcaacgaagagcactcatttatgatgtaactattatgtacctagaccggccttacccgatacattacttgcttcccataggaagaaggtctgcaagcctccatatgattgattctcgcaatgaagtcttcccgttgattccacttctttctcctctgactcagtctagcaaccccaccttggtctcgtagcccacttgtagccatcactaccgcgggtctttgctcatagtcacgaataagcttctcctaagtcctctcagcaattcaaagatgagactgactgacttctattaagtaatcggataagactgatgcactcacttttaagacttccccgatctcctacccggctaaaaactagaagtcagcattctattctaatctccggccttcatgccaggggttcctcctccgtaccttttccttctgtttggcttttccccagcccgtgagaaattgataagccaatagagtcaatcgtcaagtcgggatatccaataggtttttttccaggtaaggaactagaatagattcatacgaaagtggctttttggttggtagcaggacggtaattggcaacgaagcagagatttattttacccattaaaaagtatatttcaccattcctctcgtcgtccagaatgggtgactcaaagaaaacgtttcattcacgatgaggcagaattgacataatataaccaagattggatggtgacatataatatagtaaagtaaggggttcctccgcccgtcttcgatacaatcattgcgatgtgtcactcaaggatagctagccattcttctctacccatgccatgatttacagatgagctcgagaccattattgaatatattatgaacacaatttgccaagagttggttgtgacaaaagtgattgggatgcccatctttggtccagaaggggttctctatgaaaagagtttccacctttctctactcgaaaagccctatctaaaagggcttgtctggatgaatgcagtgtcggaagccgtgatcacatagtaacttccgcccacagtgctattacgacggcgggtcaccgggagtgaagtaaactcggctcctgatgtagcattcattcggaccattcgacgtttgattctttttatcagggataccgatgactctgtgagaggtgttcttcggccaagtttcccatgacgggttacccggttcaaggcttttctatataatgagaaatactactttctttctagcttaagtgttcacgtaggtaaaatagcttctatagctccatccaatagtaatcaacggagatagagtccagcggttcaaccaacgcttctaaggagagcggggcaagcaagaaagcaggcaaagtcattgagcctattctattccgaaagttcaactactggataaacaacgaaagccgtcggcattcttctcctactgtagctgctacaattgctttagcgcgagcagcaaggaggaggcagctcttactaaaaaagcaaaaagggaagggcatgacagaagggagatagacctcctataagcattactctcttttgaggtaacttacttacttactctgatatgatgagttccgtgggctagtaagataactattgaggtgagggtccgaaggagatctttcactatttatgcttgtacagttttatgatagttttgtaagggaaagcaaatcctgagaatggaatgtaagttagggaacagtagtcagacgcggaccagcgcaggtgggcgccacagctgtcttcctccatgtgatatctgatatcacgcaacaggagattcttcacccttatttattgacacgatttacaaaagaagaaccaacccggtcgtgctatatgtatttgggatcaaaaaggctcactgctgtatgatataaatctttctgaatgagagttcatgagctacaggaagagatcgagtctagaataaaccttagaagtggcaaaaacgacttactttgttgcaacgggaactactcgccccgggcactggtgaaatagaatcttatgtgttgcagctacttatgctttcccaactagaaatcaaacggaacaaaaccgagtcttgctatttagagccagggttcctccgggggtcacaaccagagacctaccagccccatgtaaaccactttcggaagggacaaagcagttgaactcttgagaggaagagtctaaccacaagtcaaactgtgaacatcagaaggatcgatatattggtaatagctctacacgagagaattgaaactccacctgcaattccgagtataggagagtccagtcaataataaagtcctggttgcagcatcgggtaaatgggatccaggtaaatggcttactgttcggtcaacatttcatgattcgtaattagtcaagctccggccggttcctatgtggtgaatagggatatatttagtattaaagacatgcgagtgctccgttcgtcagtaagcgaaagagactgaaacctgggagaattccgctctgttaagagagagaactaacgaaaattggagactgacggaaggaaaggggttcctcccttctcctttaggggagaagcttggttcctccttctccgctgagaggggagaagagctgggttcctctttgaaaactctttccgtataggccagaaaacagcttgcttagagaaagactgactctcctacggacctggtggaccttacagtcgagttattgcatcgatctcacaaactatcaatttcataagagaagaaagatcgtttttagatcatcaagtgaggacaggtagtagctctggtagagcgagggactgaaaatccttctgtctgcggttcgaatccggactcacttctagctctggcacaagttcctcatccttagttgtttgatgagcctgcgtagtattaggtagttggttaggtaaaggctgaccaagccgatgatgcttagccggttagagcaaaggacttgaaatccttagagcaaagccagggacttgaaatcctttttgtgtcagctctttggaagtgccttttcctttacttcagtaaggagtctcaaaataggaaatacctagctagcaaagtaagcaataacggaaggtaacgaattctccgtttcgatattaacaatccggatctagggaaagtaggttcccgcatcacgtaaatttcatttcttttgggaaaataatacataaaccttttgagtcacagccacctcagcacaagttactcgagtagcacagaagccatcatcaatagcttgcttgcctgggagctcaaccacgaattctctgtcttctaacctttctatcacttgaggattatctacgcaattcgtaaatgatcaaactagatagtcccttatcttactggccagtagtagaaggggatcttgaatcaaagagttcctgtccaacaagcaaggaatgtcagtcataaataatgaaatccatataactctactccgggttgtgagaacatcgtgcctgttgcgattgtgtggctttccgcatggttggagaccccctatgaacaaaaagtagggtggtgtaggagaaccccgactccctaatgcaagatagagctcttagggtgcgtttcgtctttgtcaggaagaaaaaagtggcaagaggagtgtatccatacccgtaccgaagagatcttgggaaggcatctctatagatttagtagttggactaccaaagacccagacagcttcaaggttaggtcttcagtgttaggtcagttcgaggtcagttgttccctccgtactgttgctagagagctgctttccatctatcttcctacatgaaaggatctaagtctatccaaataaaatagcccagaaaatgacagccatcaaaaggcgcgcagcccatatagcctcggcctgtccaaatgatgttcagcggtctctacccaagtagctgtggcccatgatccaaaggacccgcaaccagtcaatcatgctatccttaccttccaaccaattggccaatcacgctatccttaccttccaaccaatcggccaatcacgctatctccttacctttcaaccaaccccttcgattccgcttctgcagcagtatataatctcggtcccttaccttgatgcctacagctcaatttgttttccagtgatggcaagaatccgatccgcgaaatactgctttttcttttttcttgtgttgtttctgaatggcatcatagctacacgagggaaagcgatgctgcccactctgccgcaaaagggggccgctttcttcccccccaaaatgccagttccaccatcagggcccagcaagcagcataattctgctcctcgatcggacttcgtgcaattcttttatatgtaaataagggaggggtctcgaccacatttttgagtaatagtaataggctaaggcggattcgtctgcttcgcttacgtagtcaaaacattctcgctggacacctggtaaggaatatttgtatatgcgggaaagatactctcacctacagctcccgttactagtagttccggttagcccacttgcccgagcacactctcaacttgtagatgatccaacagaaaaagcaagagaccacgaaagcacgcatgaaaacagcccttttgaaagcatacccaaggcacccatccaatctgaacttatagacatcaagaagaagatctattaacacgcatggctacctatataacaagttacctctgacctcttctgaaagcatttgagacttctcgtgctgaaaaagataatttcattgacctacggcacggaaggaaagcaccgctgctagctcgccttgtccacggaacttatcctgttgagaatcctatcttgcttgactgcgctgggaagtctttccttaaagcattgattttacttggagtatccgcttaagtgagaaaaggaacttgatttagcttgaaccttgagccgtagaagaggacctttcagaaggacggctggctttagcccttgagcatggacgagagtgaacctatttaaaggtttactgtatcgtttactggtgatgggaatatgtaatattgttgtagaagtttccagcctcacaggctttagattgaactatggaaccgagcgaagacctttgagattgagattccccagtccacttatgaaatggatccgaattaaccgctttcgactgagatgtaaagtcaccttcgcttttgcttttcgtattctatgcggctttctccaactctaatctcaggtttttccttctctatgaactctatagattgatccacaaagagattgtacctatacctacttcagtataagtttatcctgaaccctatggcacttcgttgcttgctccagtgagctacctatttaatgaaagggatatttttatcctttttcagtgtgtgtacacgcttgaaagcggaaaagatgaactcagactaataaaaggaaacggaacttagaaaacaaaacaactaaggatgggctctccggtggatgaaacgacccctaggagtcccttcgattgggtgagggcgaagcaaatctacaatccttatgggaggatgggaggcctaccacaaatatggggatgaaaacaggcaaacggtctcatacgtcgtaaataagcattcttaatgtcaagttggtagataggccatagctgtcgccaaccaagtctattagaaccatcacagtttaaaatttagtaagcgaaggtctctttatcatccttcccaatcacttgcgtctaccctttagctactaatgacgctttctatctctcaatagaaccatcaggatgagactggatcttatacattagagcctataagcctttgtattaggtggtaatgtccgaagtcttcttggatttgagtgcaccaatttatttttgcatggcctctttggtctcattctttttctgagaagaaggttcagagacagcaagaagattgttcaaagaagctagatagtctgctgggaatgtgtgtctattatgcagaggaattgaaagagaatgtgaacagagaatcaacagaaagtttcccttcttctttggtaccgtagaagcttggcgatgtgaaaagatagaattcttgaacgagcgaagaagcaatcggggcagcgtatagccttagtcacgcgcatccctttcctgcataaagatgagctagatagcacggctttgaaagaaagatatctgaggcaattttccattcaccttttcttgctggtcaagatagtaagccgagacttctgtagtagctttctgttccttggataaggagtcagttgaaagtggtgaataagacccgcaaatccccctctaaatggttttttcattttcaatctgtaaattcatgaagtcaagaagtgtagccgaatcaaatagttggctctagtctaattgactacttggaaagaaaaaagtgatttagtgaagtctctttgatgcgctacgaaggtcaagcaggaaacagggaagccctttcgacctaagccaggctaataggttgagtgaccaggagagtagaccagagaaaggttatgtaatagaggcaatagtgagccccgaagagtgcttttctattcttccccttattcgctacgtattcctttcactgggatttttcatcgctcctaatactatgacaaggctcgcttatggctcgctcccgtggctctagtagtagtccattttattcagaattattctttctttttgttgatggtgcgttggaagggacgaaaggagctagtgagcaatgacatccgcgcggggaataggcttgcttcttcctagcgatcgggcggtcctccctcttcctgttcaccgccggttcgcccactgctgctttcatagatgtcgtgcgaagggacagagctaatggatgcctattccgttctcctgctcctgctccagctcaagagttcaaacggacagaggagagtcctgctaccgaaaaaaaagtgcataatattggattcaaacaaaggggatttattcacgaatacgatttctattgattgaaagctttcctattactgatggcaaacgggcgagacggagaccgtcgaagaagtgccttgacgcgccgcagccactactttgactccttttatgcaattatgaactccacggaactttctcgattccaacgcaacttatccttttggagctgacgtaacaaactaggcgagcctcccaacgaagccaacataaatcctatccgaataaaaaaaataaaaggcagtttcattatggtggtataccaacctcctgttctggaacttccagttccaatcgaagcatatagatccgtaaatagatttgtatgtatagccacttcagccgtgctcgtcctttctcgaaagtatcttttttctgggaacatggttaaccaaaaattattatgtttgcgattcttcatccaccaatgcagaaaatgctcaagttttccattcttatatgaggccggaaagtttattagcaagaggtcggcatgaagtgattcatcatgctcaaacatgagccgatcgttcgttagggacggtttatagatcatcaaattcccacaaatggaatgaaaagtgggtccatgtaaatgatcgagacctcgcaaacaacaacgttccttccccatatggagttcgtaacccaaaggcaatcgttgagtgaactgtatcttctttgtgttagttgacctaagccgcaccattactgctggggtggggctcggcctccgaaccgtacgtgggacgagtttctgcctcatacagctcgggccgaagaccgggggaagtttaggagagatggggagacccagcagctgccggtcggggcgggggtaagcttgtgaagaagcgagcttatcccccccaaaaaatcctatagcgctagcgcttcgcgttctttctattttatctatctcatttcattccgggataggcggctaatactaatctaataagtgaagtagtcgtcgtctgaccaattgactcggacaccagaccgctcgtgcccgcccattctgtctcgccctaaatggaatggctctcttagttacgctgcaccccgacccgagtccccacgtccgctcttctccgtccgcaacctaagaagttggctttgccaacacaacattagggccgtccccttcattctatgctgaccccgcccggcccggggctggctttttgggaagcccgttcccaccgcgctcatggcccggctggcctgccagcggtagtgggaattatcccgttccctggtcaaagacttggttggatgcgggatctactccacgaggagcggtacggacgtagatgatatcatcacgacctctcttttcgtaccgctagggatgcttaacgccacttcgccaactagcgttacccgcgctttcgtgtctctcagtgtggtcagcactgggtgtttccgagcagcgaagcttacacccattcgcattaattcatccaaagttccttacccttatgcacgaattttggaataagccatcttcctatcaaggttaaggagtcaactgagcatctcagcggcgggattgaatacccggatcgaatcagagttcacgccgcccgccctgaacaaataggaggcgtgggccacaggtcgcacataagccgccgggtcgcacgacagaagaacacccaacatacagatgcacactcctccatgtgaaatattcatcttcattggaaccttttggtagtagtcgtgaccaacagccatagccatcagctgtcggctccttggtaaggcgagagcttcaagcccgatttctggtggcacgccccccacacaagcaccacccaactcaggggggacggggaaagctagaggcccaaaaccttcgacccttctttctaaatctaaatgggggtgcccggagcacctcatcttgtcatttcgtcgttgctcattcccgttcggccgaagtgtttggcctttccttctccgcgcccgctcacgcttcgctgacctatcgcgtgctaaaaagaggaaagtacgaaagaatagtaaacagagcacaccgcagaaagattctaaatatgagaagtcccccttggattcgagaagacggaaatgaagaacgggaacgaaaaaaaataaggcctttctagctctagtttcagatgagcttctcccaattatgtctggtaatagaatagggcgacttgctctgaccaagactccactttttgctccgtccatggagcgtatgattttccttgaatgtagatagaccaaaagagggaatgaagagataggaataggaattatagtaccattggaaaaaggggcacccgtgggaacatctctactgacgaaccatttcaatagtacgggtgctgccgtgccacaaggcacgaccataaaaataataaaaaagaaaaagttatgtagttggaccatctgctctatccgttcgagtttggcttctctaaagaagagaaggcgctaaaaatgaaaatgttcgcaaggcataccgaaaggataccaatgaagccgaccattaatgactagttcgaacaccaggagcggaaggagggacttgaaccctcaaccttagccttggcaaggctatgctctaccattaagctatttccgccagctacggtagtggcgaagcactactgagcaattcacgtattacttgatacggacgacttccgtttttccgccggaccacggctcttgacctccgatcgagctacgagcacgagtaggtaggcggcatctgtctttttttttttgaagttgagtcatttcctttcctaagacggctcctcttattctacgataatccaagcagcagctgcccgagtccgctcggaaccagtcgattcctgagcctggactcaaggtctctcctgcctgcgagtttgctgcgaatgctgcgagtaaatacatgaacgagacgagtgagttagtctccgagcgaatccggcgggtctttcaaacatccaagttgccacttttcagctacttggaatgcatgagacccctgcatttaggaatcttaggttacctccagccttctgaagcgagttgaccttctgttgaccttatatctgtctaccttatataataatgaatatgaaaggaaagcactaactcctgagcttgggcaaagttggctaatcgatttagactattataatagaataataaatccgcgacttgggaaaccctttcttcattcgtttggcgggaaaggagaaaccatttcttcattcattggcgagaaagcatttcgtgccttcgtcctaggctcggctacttctttctcaaataagacaaagattgcactagaccttgagcccgggaagaccgctactagccctttactctattggattgatttggtcgagacccggtttctccttcctagaaacctgaaactgcaatccgcgaacgaccgctttcttccttattagcctaatatcttactctcggactacatttgtctaagagcagttgaggaatctgcaactgaaagaaaggaatcatggaatctgaacccaaggttaaaaaaaggggaaagaactacggaaaaggttctatcacgttaatcgtcacccacttacgctccctagccatctctggaattgaacttcctcggaacagctacaatgctttgaattcctctgtgctttcacgaacaagccgaataaccttctatttcggaagaggcattctgataccattcacccatagatgatattgagaattctcaggttgaaagcccatcaacttaacgctatctggggccattcagaaattataatccacgaaaggagccatcaccggactcgagccgggagaacctttgaacaatactggctgcctttgctcgttgacgactagcctttgttctttgaccgagatgtcgacctgatcacttttctcaaatttcagcaacaacaataagaaatagtagagccttcaacgggacattcgaacgcaacaaagggtttcttgaccgcctttgaacgacaactcgataatagaatagaagactttcttcgtcgacttactcgctcgcatgacagcatttagtggtctcttcactggcttaggctatattggggaacgctcggctacaagattgaaaagaccgatatgatagctccacggccggagccgatacttctctctcaaaccattacctttccccgccacattcttttttgacggagagacgattcaagaggatccagctaggctgaaagcggaggattctttctttacctgtgccccggacccaagctcggctgaaggcaaggaattctttctagactgacacgcaagctaggctgaaagcaacccgggttacagcaatggggattctctcttcaattagaaatgatattatattggtgactactcccttcagattgaagatttgaaagataacacgcccaccgccggatactcttcacgtgctgatacctatattggattggtgaacaaccctggagtttaggacatttgaaactatagaaagaccttagccgcttttatgatatagtcctgaagacctaactcttagaaatgacctactaactcatcgacaaagaaaggacttcgccttgaccttctgacctagacgtcgaaccagtgccttggattcatcaacaaagggatcaaaggaactcatctgtccctccaaacggaaatcttggttttgtaatttgatctctgacaaagggagagggaaagaaagaccaatccgtatctttgaaagaaaaagattctcagaaacgctaccaccgaacatcgacttactcggcatcttcggattcaagcatttcattcgttcgttggcgcaaaagcctcgtttggcgggaaagcattcattcgtttgcgggaaagcaaaagcgttcagcattgacttcctaaagcgacttcttagcgtgcttcaacagcgcccagataatgccttgaccggagccggagggagacctaaacagaagaacgacctcgcagtggcaacatagcccatcctcaactcatacctcagattttgaaccatactttgagtcctcaaactttgagatggactggaccaacactcttctttgagatggaattcccaccactcttatttgacatgaactgtaacgctactctttcaaagatacctaacaaccttagctggcattgatcactcttccttcccaatccctccatttagaattgcaaacatcccaacttccagagctacctatgagccaagggcggagggagatatattagactgatcaacttcaaacaaaacgaccttcctggactcgctttcatctccttctttgaaacgactcaaataattgagtgggcattgggagccttatttaatggtggattcctgagctatgaatgtctctgaaatcgtgatgtcaaaaaggaatgatatgcgattattaacttgcttccttccctctaattttcatgcagtagttgaatttttgcactcttacctggatgcgattttccgccttgaatagatggaggtgttttccaccttgaattgagaatttttgcatgctcgatgggatttctgccttgaattatgatacatttattatgaatttttgcatgctcgatctgatttccttcgctgtatgggagtgcataggcctattctagcatggggtttctcggggtaaggcttgtgcttttccttccatataagactagctatgtgctccctcggtacgcctgtattcctttcgtggattggaacctacgtactgttgtattgtagcgtgatgttttcccactgctttctggcttgactcacataaagtacgtgcgtaactggcactatcatgtaggtgcgaaatctgtcttctcctatgtcttgttctcccagtttgattcctatgtttcgaagtccagctaattagtgaaggaaagtggtatggatgtttggagctcaatccatcgaattcactcgcttctttgcgctgcgttgtagctcttagattattgggaggaggtcatttcgaatgttttgtaatttggaatcgttttttcttcaaggcacggcttcttgaatcgtctttgtcttgtagaatggttgtcatctggaatctaactaaatagttagttaagaagacgcgtgctttgtttggttttgatctggaatttcactataagataagataagagtgaagtgctttgtttgggcaatctgcctccctaaatctagtggaggtcccggtcccgccgctcctgtttgtaatggggccgctttgtgccaaatgtgtaagttgttttttcaatccgttctaactgtaataagagaagagggaagtccgtctaaagaaattagtgaaggaaagttatatggatgttcattagttcagtaaagtgttagtaatgttgctgggagtaaccctttgatctgatctgtctttgtacgtgttatcttgcgaggctgtcaggttggcttgtgaggatggggagaaagcgggccgagaatcttatgtcaaaaggaccaaggatgatcttttcggaaaggaggagtaggaggagtcagcttattctatagatactgtaaaagccaactcatgtttccactcaattttcattacgaagatgtatcacgtcaagatccgttgctcaaaccgaatcacgccaacgttatggaagttcctggatcgtgtgaaataagagtagtaccaaaggcaccctataatttcataataaaaaatggaaaattggctatggagattccgcgcggtcagaaattcatacagacacaaaggggttcgacaggaaagtcctttcgatctaatccattcttggggtcaaataaagacaaaggatatgtaagtgacctagcacgacaaagcactctccgagggcatggaatgtctaatttttcggtcagaatctcgacagtaatgtctctattagattttccggtcgaaatacggaaaaactccattcaattctcgatggaaacggagttttgcgaattctccccggaactggaagatcatttcgagatcttcgaacatattcgggggttcaatgtgactattatcacttcggccaacacacaagatgagactttaccactgtggagcggttttttgcaaaaagatgagggggaaactcagtaagatgtcgtagaagcaaaatagtagagatcacaaacgtagattgctcgcggctaaatttgaattgagacgaaagctttataaagccttttgtaaagatcccgatcttcctagtgatatgcgggacaaacattgttataagttgtccaagttgccaagaaatagttcctttgcacgagtcagaaaccgatgtatttccacggtcgccctcgttctgtatctgagttctttcgaatttctcgtatcgtttttcgtggattagcatctcgaggttctttgatgggcataaataaatcgtcttggtagcaaccaccaaaccaatagaacaaagaaaggttagctccgcagctggtccacaagcaaggtaagtaagcccattaccagccggctccggaccgaaaagtaacgtatttaaaacccttatcttggatcggagatgcgaacggggcgggaatcgaagtgggggacctctctaccgcttgtgtctatttcctgtcaagtatgctccccatacatagactacgtacaggtagtactcttggaaagaaagatataatgcatgaacataacattaacttacgaatgtaactcccgaccactcttctaaatatactaaggcggagaactcttgttcattggagcgccgtagtgcggaggttcttcccatcatggaagtccgagttgggactgagccttccgaatgataatgctttgtttcgttggaaaaaccaacgcaaatctcatattgactttctatcgccctacttctaaggatagatagagagagttactttatgaaattatctcccttctaaagcagcgcaagtcggcccccccagaacaaagcccctactcccgagaggtataaatgactcgactaaaaggagaggtatttattactcgagcacttgttgcgagaggtccaacgtaatttattactcttataaaagagggaactcgactgaaaggagaggttgtttacatactcgactaaaaggagaggtccaaatggacttctgtgaattacagtgatccagtctcacggatatggagcttcgccggagatggcagggcaaaacctgatggaccttttttttttttttctcaagaggtgatttcgagaatcaaccaaccgacgagactaattcgaggatgtgttaaaagagagtctaaccgccaaggcaagtcccatggataagccccagcctccctctcgtttcactctcgttcctctccttacagtcgagctcctttgttccttcggacctctcgcccaaatgaaatgggatgaatccaatcaataagcttattgattgattcagagcgcagcgaagccaaattcaatcaaggcaaaggggggcttacttttcctgacgctgagtcatcctattcaaatttagctatgctaatgtaacaggaaaagttttcacagatgatatggatcccaagagatgagcgagaacctccaattgcttaaggatcgcactccgctatcccgcttggtggacgagatcttctctcgggtcatccatcctgggttactgaagggttgtccgactgctcggtgaccgaatcagagaagttttgaccgctttctcttctctccagcactctcggactgatcatccaatccatcttgctgcgacaaagcaagcttaggaatgaatctaagaaatttaggtctctgcccgcttgaaagattcttctttccttttcggtgaaagagggcaaaagtgtgtaggagaaagaattctaaaaacgtcgacgcttaattcgccccctccatccttcaaaagtaaaagaaaggctcaaatatcaatattatatatatatttgaggatattttagggccctagaacgcaaaaaaaaggtgggtgaacaagagttgtcacgataggaaagagaaatgactataaggaaccaacgattctctcttcttaaacaacctatatcctccacacttaatcagcatttagtagattatccaaccccgagcaatcttagttattggtgggggttcggtccgttagctggtatttgtttagtcattcagatagtgactggcgtttttttagctatgcattacacacctcatgtggatttagctttcaacagcgtagaacacattatgagagatgttgaagggggctggttgctccgttatatgcatgctaatggggcaagtatgtttcttattgtggtttaccttcatatttttcgtggtctatatcatgcgagttatagcagtcctagggaatttgtttggtgtcttggagttgtaatcttcctattaatgattgtgacagcttttataggatatgtactaccttggggtcagatgagcttttggggagctacagtaattacaagcttagctagcgccatacctgtagtaggagataccatagtgacttggctttggggtggtttctccgtggacaatgccaccttaaatcgtttttttagtcttcatcatttactcccctttattttagtaggcgccagtcttcttcatctggccgcattgcatcaatatggatcaaataatccattgggtgtacattctgagatggataaaatagctttttacccttatttttatgtcaaggatctagttggttgggtagcttttgctatctttttttctatttggattttttatgctcctaatgttttgggacatcccgacaattatatacctgctaatccgatgtccaccccgcctcatattgtgccggaatggtatttcctaccgatccatgccattcttcgtagtatacctgacaaagcgggaggtgtagccgcaatagcaccagtttttatatgtctcttggctttacctttttttaaaagtatgtatgtgcgtagttcaagttttcgaccgattcaccaaggaatgttttggttgcttttggcggattgcttactactaggttggatcggatgtcaacctgtggaggcaccatttgttactattggacaaatttctcctttggttttcttcttgttctttgccataacgcccattctgggacgagttggaagaggaattcctaattcttacacggatgagactgatcacacctgatcagtgaaaaattctgacaccaatcatttacatattacaccaagaattgacaagcagataagttttctagtttgctatgttgatatagcttagatagggaaaagataactccactatagagtagggctgtacttcaaaaatcaaaaagggtccctctccccctttttttattaaaaaatcaaaaaagaggccccgccccccaaggcctaaggaaaaaacctctgataaagaaagaaaaaatatagaactaacctttacactataaccattaagtcaagttattaacaatcctatactaagaggagaattcggatcagctcgggcggaagaggagaggcgaagaagaagacaataagcactcagattggaccaacctttcatttaaggttcgtcattatcttttcaatcctgactagaatcaggcttctcttgaaaaaaggtaaggagttattcgatataatatggtattaaccctagcgcctaagtcacccccgcaaggtaggaagaagataaaggagaaagtgaacggaggaaaaaaaggcgataagcgaaccggcgggcggtaaaaaccacaaagaatttatatagaaaaataggtactaccaatatgaaattaagaaagacatatatacctgaaacaaaattctgtaatgactatgtgaccatgaagggagtagttgattcgcgttccaattcattggcaaaatccggtataaatataataatataacgagatcgtcgtcttgacaaagatgaatagaaagagtgctttttttttaatggtaacaattcttattgtttttttttcttcgaaggaagatctttctttgactaaaaaggtttccatttttaatagattgtttgtggttgtacctttactgcaagaatataaatgactcgctattcactcgaggtttctgggtcataatgtaggagagatggccgagtggtttaaggcgtagcattggaactgctatgtaggcttttgtttaccgagggttcgaatccctctctttccgtacctttacctaattcaccaacgttaccgaccgcgcaataccaatcgagacctctaagacgaactaaagggatgtctctaagcagccaaggccaagagcaagcaggagtggtcctatccgcccattcatttttaagtgacttataagacgtgagagatactctaaagtcataacggggaaggccagagacttcgttcaaatggggggaggttttctcttcaataaaatgaaaggcaggtatttttatacgaaaattgagaattcaataataaatgttcacttgagattaggttcgcgaagaagaagatcacaaatgagatcttgagcttgaagcttactctccagaatcgaaagatctcttatccccgaggcgaggatggcttcataaactttttttgccgaaggaaagatagataaggggtttcatccatatttttctcccatttacgtatcacgttcagagattttaattagttgtccgctctttccgtacctttacttaccgaccaaataccaagactacttacaacaggtggtgaggatcagcacactgcgggaatctaaggaattgattgctgtgcatcgaccaatctcagaaagggaactataaaagaaggtgaagatgcaccgaggcatttatgaagacgcatggtatgctgtggagaaaggggtgaaaggagtagaagcggcagggcaagaaaaggatagtgataaatggacagacgctgagaagaagaagtcgaaagtataacagcaaagcactgtcagcaatcgcaagtgacacattcaagggtgaatcatccaaagatgcttgggatatcctacagaagggttgacaagtgtaaagagatctcgtattgatatgctgctggcttcacggaggaaagagagaccattgaacaattcatctgtgctttgccaatgctgctcaaaatgaaagacaaagacaaaagtcaaaaagcttctgttctgtagcacactcccggcgaagcagcccttcgcaagccatgaatgacatagatacccttgcgtttgatgttgttgtaggtcacctacaagcgtatgaaatggagactgagaagtccgagaaaaagcattgctgcagcacacactaagacaacaagagagatattgaagattcaatcggcagcacactgcttgctagaaactttggcaaagtagtaaagaagaatggacaaagtaggaaaaacccttttacacagaacacaacaacaaatcgtgatcgtgtgtcaaagaagggagaacaacagtgtagggatatggcaaagctgagcactgcctttttttagagaagagacttcaaatgtttttaatgcaaaggttgcttcgctaggggcacacaaaagctgaatgtgtgaatactcccttattggtttgcttggagcgagagcgaaacagacgaggatgatgatgcagaggaagtctctggattcgtagcatttgtgataaagatgagacgcttcattcggacaattgctttgctagtgaaacaaatttgctgctttactcaagcccacaccctcaaggggttacttcgtcacctccgtcaaacccgcgtcaaagcccctcgtcaaagacctacgtcaaagtaggttgcttcgccacctccgtcaaacctccgtcaaaggaggctgcgggaggctacggggctgcgggaggctgcgggaggctacggggctgcgggaggctgcgggggctacttcgctgggagtgtgcgcttatgctgaagaaagaaagcaggtccaggttcaaagcgtaaaacggtgaaaccaaaggcttcttcaactcgaagaaaaagcaggaacggaaagaactttacttcctggtgaagcaattttcaggatagaattctgccagcttaggaatctgaacataagcagtagagcgagggcatagattactctggtcatgccaccccagcaattccaagaattaatgcaagcaaagcataggagtgtgatttctcgtttaccttcttttgctcttaggaataaaggtaaaaagaaaagcagtgtgctggacagcacctttcctacgtttgaaaacgaattgccggtactccacttagacttctgcacctgacctagtggctgaagaaggatctccctcaagtgatttgctgcttcctccccgacgtaggtttgacggaggtatcagtctcgttgctaaagcaccttcggacctcttttttcgtctattctttggttaaagctaaaaatatttcttttcattttggatcattcagtagctcagactggaacttgagagctataaccttttttccttaatttcttccgttgccgtatcttgcatatataagatcgagatatctctagtattcataatccaggatttcgccatactcttacaccttacccagatcttataacttataataagatcatctaggctaggacgaggcagactaccatcaataaaagagcgcttcagtcaacatatacaaagtccagcatagttagatccattaagagttgagccagacccggatgatcaccgaagataataagggctagaaacattatctggtgaatctgagacaacgaagctgcgatcggcaacacaaaccattggagtgtgctggggaggatctgagctgtagaaacccttgatccactaggtaaggttacttccagagcggagtatgctcaggtgaaactggtggtgatgccgatctcttctttctcgatttctagttccgtttcgccattgttgaggaaaaaaagtgatccgagactcaacaaatcgaagagaaaaggaaaactttgttgattcaggaactgtgaaacggaaagtctcaccagaaagtaattgcactctctttgaagagggtcttccctttgtaagcaaaggtaataaatgctcaatgaggaaagattatgaatttattctttcatttcggcttaacatctcttaataattgtttccctgtttttaatacaaaatttgaggtgaagccttctctaatgctacgtgtcttcatcttagcagatctctaaagcttggagcgtatggtaacggttagaagtgggatttgagccgctgtactgtggcagagaatgacgtcgctgtacgttcatggcttcagctctggttttgttttaagtgataaataagacagaggatactttgggcttcggtttgtagacaaaactcgtcttgggcttatgtcttgtagtcataggagagctgagccttgtgttggcccagttttggttcatttagtgaaacagtgtcgttttgagttgtaaccggaaatatctccttcttcctttgactgtcgatctcagtgtgggtggcttaacgagatgttagggctaatgttagtatgtagtgatgtgctgttgaaggtagatacactttataccttcttcctgaagcagacgaagcgagctggaacgtacaaggaaagagaagatgcctcctaatctacttatggatgtcagagttgatggtcgagcataggtccattagcagatggaaagaagattctgcttagcgacactgcagagtcagatcggcccctactaatgagaaggccttgaaggaagtgaagattgaggctttcagggtttagttaagactttgccggtgactcttttcctctcgcttcgtaaaaagaaaactcttccatactaagattaatgagattttccggtatacttcccagtcgactatgtgaacagcacaaagcaaagttttaccctttagtgtccaatgatatcaatggtatctttctgtttgttaccaaacaggagggaagctttatggtttcgtaggttttcttctactttttcttctactttagggtttgatagaatcgtccgctattacagactttgattatctgtggggcagtgcgttagacaaaggaagtagcaaggaagatgaagaccggatattaaaaggaatatttcacaaagccgaagcattacaagcatacataaaagaggaagcctaccgtagacccccacacaagacaaagttcactaataacatagtacgtgaacacaaaaagacatagaaatagaacaaaaggagaacaaagaaaagccatgcagtactttgggtcgaccggactccttatttaaatattagaagagagtggttctagtctccctggcgctggagagcgtgttcgatagtacacacaattaggtagttccgctcctgcaggagaccagaaatcctttgttgcaggccgcgaatgcggtcccgtaagacttgcatccttgcacccacaaattccgggtccagagcaggcgggtgctcccagaacaagcccagcatttcctcccagtggagctttgcgttttccgcggcttcgatttcttgtggaatggtcgccagcctgttatagatctccatatcatccatctctcttaactttcgacttctaagtgttctcaaatatagacggaaagctgcttctatttataggcaggctagtcttcttatcttaacttaatgagtcttcttacgtaacacgtttaatatggaacaccctttagtccgctgaagaattaattaagtacgctgaagactttaaaggccccatccatcaaagagttctttttggcgggtattgccacgcggcttaataccgatcactccctcagaaagaagaggcaataatagaacgcacagtagagagtactcccccgcgtttctcgcaaagcccagagcactccttactcgacagctcctgaccagagtcctcgttggccctacttgcattagctctgcctgctcagagctcgcttttctttgtctatttttgattggctgattcccaggtacataaaagccctcggccaatccttactcgacagctccgtcctttcttaggtgagctaagaccgaagctagctctcttgaatttccccggaaagacggaacctttccagctcactctgtcagtccactaagacgcgtatagagtaaatgagcactagcaataactttttcagtacaataagtccccttctccacgaccacttttgtttttgggctttcttggattcgtttccccagtaattccattttggactcggaggcttttccattgggctcagtatcataattatcccaaaagccccctctcctctagcttgcttctttaaaaaacaaagcacactgcttgttaatgggcttatatggatcaaagcattagatagaatgctaagtccaattcctcaatattcttcttcttcagtggcccaagcaagatcatctatcagagaggatagggtccaaggtctgactcttagatatatcccctactacgagttactccgtacctctgcctattactgaacaattacctaatgagtgcgggtagcataagacaaggtgagcaaagagaggtctcaaaaagtaaaaagacgggttttactttttgacacagttttgccctcgtatctagaaaaggataatttacggaaatagtaaaagataggacctcctaactttcctgctacgagtgattaaagacggggtttactctaaaaaaacgtcaaaatattgtacgggattccattccccggttggtttgtttaatcaaacaagagaaagcacctcttttccaaaggcagactcggctgtaaacagaacagaattattactaaaaggatgttaatgacttatggctcctgtcttatttttctgatagggaaacggaaatccataactagggatcctcctacgtggacataaagggattggagacagagaaagtgattgtgctaatactataatggttcgctagttgctctcccttgttctctaggttcggtaacctgggtaaaggctgccttgcttcccgttgtggaatcttttctaatccttttggccgcttctttccactcggaccatagggaagtcagaacggaaaccaacaaaggacaacacaaacagtctatctcggcaggagcagagcggctacgcaaaccgcctggctattcatattccgacctgaggagtaagactctcgcagctactcagggtattgagctactactagggaggctccggagctttaaccaaaggagagaaaagtacctacaccggtttatacaacaccggttcacagactcaactatacaattcatcacaatcacagatgcaactatacaattcatcacattacatcacaaaattcccccgggatcaaatagagatcaaacccatcttacttaccaagttgtggaaaggagttggatgtaatgcctttgtgagaacatctgcaatttgtagatcagttcggagagaagcttgaatagacctgcaaccaacttctaacacacagtcgatctctatatgtttagtacgctgaaaacaggatagcaagatgtctggcagcagtgttatcacaaaagggaggagcagaagaactcatttgaatgccaagttcctgcaagaaatttgtgaggcaaaccatttcacttacagcagatgcaaggcttcgatattctgcctctgcagaagacctggagacagtatgctctttcttagagcgccaagaaaccagagaggaaccaatgaacagaagccagttacagagcgccgtgtgtcgggacaagaagcccagtcagaatcagcaaaagccttgagctgaagatcagatgtagcagaataaaaaagaccctgcccaactgtccctttcacatagtgtaaaaccttgtaaactgcctgcatctgggctgtacgagatgctgatgagaactggcttaacctgttgacagcaaaagtgagatctggacgagtaatagtcagatacatcaacctgccaataagcctacgatacaactctgcatcaaccagatcaccaccagaatccttagacagagattaggttccatagggatagaagaggtctcagcgagccaacaaacctgtctagatccagagcatatttgcgttgacaaactgaaataccctctgtagaccgagcaatttcaagcccaaggaagtaagaggaccgaggtatgaagttgcaactgatcttcgagagtgtatcagctggaaaaatagcttctctgcgccaaggaaatccggatctctctacatactatacgaaaagcctctttcttcacaaagctggaccttcgttcgggctattggaaagtcagaattacagaaggaaacgagcctaaaaccacttacttctgttaccagatatggctttacgagttccttgtcatgctgataagaggccagtcgatgaggctcttgaacaagttcccggcgaagttagccctataagctaaccgcctgccatgtctaccccgaaggtatctttggtgctgttgttcctaaaagtctcttctttaactttgtttccacacttcccctgctttgttgtttcagaattgagaggcacgaaatagcccccaaaaaaaggcgaaatccactatttcatcaatcaaattttcgttcgagggttgaaagcgccagaacttttgaagagttttcgccccaggcctgtcatccgggggatctctttatgctcgtccactcggggatgacccctactgatctctctcatcggatcgaatcgaatccactcctgaactccagaagcaagaacggacggatgcccgaagagttctaccgttgacgacagcagcgggaatggatttcaaatagcagctgctaacgaccaccgagaagggcgagtcaagacttccagttttatgaaatagaagatccagatcttggagcacctaatcaaccagttgaggaagaggaacgaaggtactcagcctcctggggcaagtgggagcgacacactgaatgaaccaactccaatggagcaggatcaagaagaagtgaagctacgtaaaagtgagcgtggtagaatctctcgtcgtcgatttgagattgagggagatccggggaatcttattctgtcacccaaaacgaccactccttctgtcggaaaaaggacttgccctatattgaaatgaaatcgaaacgaatggaacgcgacagagcactccctatcatcaggtagtgcgcgccattcagaactatgatatcgtcttctagtctattcggcaggtccaagttgttttggtcttataagctcaggttcttgagttttgggaatttccttccattggctggttaaaattcaatacggatggtgcttccaagaggaaccttttcttgcatggtgctgcaacgggacattctggtaagtcgggtgctggtggccttctccgagactgttcaggaacatggatctatgggtatacctgcaaaatagctttctctacgagcctacaagcttcactttggtttagcttccaactaaggctaagggagttgtttccacgggattgagtgaacgagctcatagccctccacccgtaccacaaaagcgctaatttatataaaaaagaccgggaaaacgtgaatctatcccgaacatttcctaaaatactggataaactgactcagatcggtctccctcaatcgagaggctcgcttgcttcacttcaacttcatagaagagggaaggagctatgcataggggtgattccggtggagatggaatgaatgcattgacagttcggtctgatccgtcttattcgtatatcttattatgggatatttgccttaacggaatcattagaaggctttgggcggggaaacccaactgcaagaccagaggctactgaaaggaagatactatctcttcttgagcttccgattgacataccgagattgattcaatgaaagtccctagcgcaggtgagacctaattctatgtttacttttcattcaaatcagcttcctgatgactaaagaagacttttatcctggcggttgttggtccaacgactcttcttctttcttttgaaatatcgtaagagaagaaggttgacaagaagaataatttgtctcctgtgattgtagttcaatcggtcgtttgtctctagaagaaagaagcctacttgtagaagagaagaagcggggtagaggaattggtcaactcatcaggctcatgacctgaagattacaggttcgaatcctgtccccgcataaagaacaaacaaacaatagaaaaaataaaaaatgggatttgaagagtcaaagtcaaataaatgatcattcggtggggactgctccgccgacattggaacgaggccaaccgctgcttatcacaacctctggtgccggtggaggtttgacctcggcgccgatgaggattaactatgtgaggattaaggtgtcggacgtcatccgcaacgtaaagatcgtggtgcacagtgtgtacttgccatttccacatattaatcctgtggctgcggcttacgaagtatcctaggaggctcagaagtctcaggaggagatcagacgatggaaggaaggatttcgatcttcgatcttcgttaccattccaaagttaattatttagctttcgattaagtgagtgtttgtttgctcagactcagactaaaatgcgactctatgccttcccggtagaaaacgacctctgtggcgggatttaccaggtcaaattcaacgggaccctagcctgcagtcgtcaaccggtccgcttccttgaatgagagtaggtcttcccgatccacgaatactgtctgttgtcctttacttgtttagtggcatctggaattgtctgtttcggtattcactcttgtaaagggccgcgaactaagctaagcgcttggcttgtcttcttatagggtcccaaccgaccagtacattcaatatcgaaatccgttactgttacagaagagaattaagataacaaggcttggagtatctaaaactaagtccagcgaactggaagtctcttcagactccctcattgcttggctatcgaagtggacttgtacctttttcgcgtgcgtcgacacgacaatgcttacctttctagcttttacccttcttctccggaaggaatagaaagaagacaactagaataaggggaactactctatatattacagcaggagaaattccaacatgaaagaaagcaggcggtgcacttaaatctaaatagggtgagaaagcttggcttgggattgggattgttgactcatcatgatagggcatgaattgcgtatagataaggtcgagttcattaagttgagacagctgtaggctcaaaccaaactgacgtgtaaagagccctagttgaaataaaccctggtgaatcttttggtgtcttagggtaggagtaagtggaggttaggtaacccagccagaggattccgttagcgggttgattccgagctggtaatcgaacaggtcaccaatcgtcctcgaaagggcggttcaagcgcatgagttcagaggtctatagatcgtgatctgaatataaagtggattccaggggcagctgcttctataaacacaagaaaaggtcttgtggacttacggattgataacttgccagtacacgctgagcctcgtcgatgagatgaggtacctcatttaggatgactattggaaacgcgcggtgccgcgttaggttagggagcggggctcatttcatcgatcatttctgcacgagcaaagctcaatagtacatatagattcagatagcataataaactaagtgaacatggctaaaattaaaattgataaacaagagcataagattgcctacgtcaccataaaactcgacacagaaattcataagtaaaagcggcgtaagttactaacatgccacatgcgagggacagaactgccattgacagcctccaggcagtagctcccagctcggcttgcttctactaccttatagggtcccccccagttaggatctaacttgcgctttcacttaagtaaggaaagtcctattctaaaagaaaagtagatttctccctagatgcttggaaattttaattactccaccacttcgcccggtgaacttctaaccatccttttctagagaagaatagctatctttcgtcagaattgatttcttttatacccgagtgaattgaagcattcctttatgtgggaacgtccatctctagcgtggataagcctgaaggtcctactaagcggtctaactcgactcccctttctagggagatgtggacgaaggctacttgagctcattctcacatttcggggtaagaggctaggctaggaatagggtacagaggcgtagggggaatgaaagaatttgcttagtcataatagtgctttcaaagtgaaaggatataaagtaattaattcctctgcttgcaagctacctatgattttcttcgtcaccaaccatttccgctgactcaagcatggcatctttcctcaagcccctggcatttccaggatcgataggtgcatcccctcctcaaccctattttcttatacagcctatcagttattgaataagaaataggcacctcggctaaagcctgactatgccaccggtcgttctagcatagtcactgagacccaacttgcgtactcggattacttcaggcggcccattggaaaatatacttctaccaggcctactcaatcctatcttaggaagcccgcatctctgtgtcaaacctttttgaaaaggctctacttgaattgaataatatttctttattccgacttcgccaatgaaagagggtagttgaatagaccgatatatctagaaagtgtggagtgagtgaatggtggaaaaaaagtaactggcaccgccccttgctggatagaatatcgagatgcacatgggattggggtgctctctaagtgaggggccgtggaactatagcttagatagaaaggttttttaggccggacaaaggtctaggttaagtccggagagaaggcttgatgaacaccacctcctggttagtgattgggcacatgcttcctttacggcgtagaatcggcttctttttttgacgtatcagaaagggcctctcttctaccgcccgaagtttctatttatgcaagtatcttcacttcaataccccagcctatacatttaatgataaccgaacccaagcaaggagcttaaatcttgtctatttccttgaatggtcgggttggaaattattttatgtgccaacgcaggcctatcacctaatctccactgcgaaatcctttgttggaaggcttgctgatttacacctctctccgccgcttcttaacagttgactctgcgctgcgagattagcactttcttagttactaacagatatatcttttccgcgcgagctagttcaacagttcattcttgtaagcccccttgtcagccacactaagacttcgggtcatcattacctctgttgaaggaataagcccggctatttcagctctgggaggaaggactacttttttcaccgcgaattgcctttgatgcaaaaccatataccgatcctgttaagtcttgaatttacttctgatgtcctggctgccccttaagcctggaagaagagtgactcgggaagaaatctcctgctggagaggtatatccggcccttctacgaagcctcaactgcaactgagactgataataggagcagtatttttaaattgaattgctggtgccggttggttaaaggcatggggactgctttcaattggacagctaactaacaatcgattccccataaacaaatagttatgaaacattggattggatgccttttaaacaaggaaagtaaagacagctaaggtaagtattccccacattgaaagatatctatttctttcttctgttccctttgtctaataagatgggactgcaggaaagtaagtggaaagtaagaacacagttgttagcttatagcggggaagaaagaactagctcgactgaaaggagaggtccaaggtaatttattactcttataaaagagggaactcgagcatttattgcgagagggaaagcttagagttccactccaggagaagtagcttatggtagggattataggtaggctggctaaggagttgctcctggaaaggtagcagcttggtcccttgattgcggggtttcaaacctcataccaagagaaagattccaaaccagcatacgcaaagcaaagagcggaaaggtgctttgtacctcatttcgctaagcagcgagaattgtactgaagctctctttcaaacgcccgccgatcgtactacttcattcttagtgtgctgaccagatacccccaccctgagctaagagccatagcaagagatatagcgttggctgtaggcttagtgagctcataaactggcgaatcaattcatttgaaagagaaagtcgggtctagctgattcccgagttgaccaatgatagataggtaggaatggcaggacctaaacgagctaggcttcgttagccagttctccttttagaagctattcttaatgccgctcgggctcccttttttaagggattccatcgctcttggaacagatgatataagatcttactaaaataaaaaaagtatgaaaattaaatatacagatatactctataccggtatacagcaataacaatgtcagccaattagcaaagatcaagcgaactcactcaagcgtactacagcttttccgtctttcttccctaagcgcaatagccccttgaatggataggatataattagtgcgcttgaaagagatttggcttagtgaaaattcctagtcttactcatctcagatgcgggattaccaatgtcacgattggaattaggaaaggaagctgtggcacttcttactttatatgaggaaggggttaaatcactagcaatagtagacacgctacgatctgctagacaggagcagtacaggaagcatcgaatgccatggttcttgttacagactaggctgcaagtgagagtgatagaatcagctcaactgggaatgttgccgatgccgataccggagctgctaaaggaagcagtagcagtacaaccattaaattgaaatggaattgcacattcatcttcctctatcaattcatttcttttgtttgaataagctattaaggtgcctaggacactagtagacacccagaaggagttgtaagggagaacggaaatttaagatcggacgattttcaacagacaagatcagatcgtagaatagagaaggatttgctgccgctactgaatcagagtccacggtgcaacaatttctcatctgctcacgaattggattcgaaccaatcaagctacttgccctttagtagatcgtgagtgggtcagtcgtcctcctcattatagtcctcctaaaatcaatagcatttcgtcggaatacatcctgtcttttcaccttagtagtcctatgcatagtcagtactatagccccaatcatggctactaataaaataagactaggaaccaaaaaccagacagaatagtaggtataaagtaaattgcccaatgtttccaaattagtccaacttcgtacctttccggcataaaccgtatatctaagagaggtcgtatttctttgggttggtagtaatggaatgctttcattatctaaaatgaaaaacatttcccaccaaaagatcagtccaataatcccactcactggtaaatagcgcaatacttcttcgtgaatctccgctatttgaatatggaacatcataacaacgaaaaggaatgaaacggctatagctcctatatgaactactgggaagatcatagcgaagaagtcgagacctaacaaaagaagtaaacctgaagtgtcgcgaaagactgggatgggaaacaaaacggaatgtaccggatttttagcacgtgcaaccatcaaaccagagaccaaagcagggctcgacaaaacagaaagtatcatggtaccgtcgtccttccctgaaatggaactttcatgctagttcttgcttcagcatgaaagtcgatctattacgaccagcgcggttgttcctatttcattttcttcttccaagcccttctttcttagaaagcactcactgagttacttacggaatctcaatgcatccatttaatgcattcttttcgatcttgtacccacagagcggtagactgaacaccacaaaaatatcgattcaaaaaaaggtacatgcaactaaacctgtgaactcagatagccttgtggtatggtagcgagatccaatcttgagtgaaaaagataccgcggcttcaatctttttcaacataatcatcgcgcagtaaatcaacaaagcccaaagttgactctctgtctccttcaagtttacctactactgtacccgcgtgaatatgatctccaccagatagacgtaaagctttagctagtacacggaagtgcaaaccatgattcttctgtctatcaataacagcatgcattgcacggtggatgtgaagaagtaggccattatctcgaatgagccaaactagtatttgcggtgaatccccctgttaagtagtcatgcattacgataggaactcccaattctctggcaaatacagctcttttgatcatttcttcgcatgtacccggagtagcattcaaataatgccctttgattccacctgtttcagcctgtgctttataaacagcttcggcacaaaataagaaacggtctctccaacgcataaatggttgggagttcacattctcatcatctttggtaaaataaagtccaccacgtagacattcataaactgctctaccatagttcttcgcgccaaaccaacaatctgcacgcttagccgcattgttcatcttgccttaaccctacccgaaggaaggctatgaattgagctaacgccctctgtaacagcttaaatgatataggagggggttgatcctcgatttgattctcgtgttgcgagtgtcgtgtctcgcgttttgaattcatttcgattgggaaagtgagccgatccagacctaattgatctggtttctgagagcactgacaaggctaaactcgccggttgaagagagcactgaatcattcgaaaggggaagcctcgactggaatccctgctataaagggcagcggaggaatacctacagattgctcgccttaaccttaagattgctagaaaatatctaatgcaggagaataactaacaatttatgtggaatactatttcatttcgggggtaacgactttaaaacttgcctataggatcgcttgacctagaacctgtttacactggtcctgctgtgaaagctctattgataggaaacattctagccaattttagaggaacgattcccttgtctgagaaccgccattcccgcactattcctccccacattgagaatctcgataactccaaattaagaagtgagcgaatcccaaagctctcttctttcccccttttcacctttaattggtgaaagtctaaaatctgatgtgaatagaagaaaaagaaagaagaaagataggcggacgactttactatagtataggtcgaaaaaaccgtgagcagtaagcaacggatctccccttcttttgggaaagcaggtggccgcgtgtgaattctttcaaggcaaggggcggcctgatttcgacattgttgtttcactctgatccggtcgaggtggttttcgtttaccagcgcgtaggtggtctaagttcctatgaccgagtctttctggcccctgtgaacatcttttcttaatgtattaaagaggacctctctaaccggtgaaaagtagtgggtgtccactaacggccgttcccggctcggctccgataacgaaattccgggaggagtcggtagttgggcactggatcccttcggacctggagaacgtgtgacgctgggtaggggtttggtgaaccaactggtcgctcctctagttgaagtatcgggccccttttcgttgcctaggttacaccttcggaataccccagaagggaatttatctctacttccctaaatcttcacttgatgccacgccgactctcctttcgtcataaggcgtggaattagaccaaggggaatctccatagaaacaggtccctctgatttcgcgcgtaggagatcgagacacagcccaagggctatggagaaagatgtagatcgatcgccctagatagacaactacatagagggtctttacaagtctatatattctttgatttcgttcccccccccgtaagatcaatatcacaactaatgaggtcttaaagtttcacatctaagtaatacccgatccgatagtttacaatataaatagatatttatctatttaacaacaacattctaaaaaaagatattaattgatatcggtagttgtccggtcgtacccaaacaataatattccagaggaaaatgcacctaagatcaaatatttcgagccggcttccgtggaaaattcagactttctttttgatgctgcgattacataaaaacataaactttgaggctcaatagctaaatacatggcaattaaatcatgagccgagatcataaagagcataccgcgagtaggaagtggaattaatacaatgaattcaaaagcatcaaacctctcttggtcggaagaatcgaaacacatcgaaatggtaccagccgtacttaataatagaaagatttggcagaaatatgtaaaattgtccctcctaaaaagattattccagaataaatgggcaatagttaggagaggtgcgccagcggcgagcagaagcaaggttattagatacctcaggaaagcccggccagaaccacacgtgcaagtttccctgcatgtggctcgtccgtgataacttcttcggatttgcgtgaactagcagaccgatcactaagtggaaaaaaccctccagcataagcgaaccttttctccactggttaggaatgggctaagagaggaagccaaacaaaccgacctattaagcacagctaagctaatatgcgccggggaaagccaggtgccggaggtaagctttattcggcccggagcattgattccccataacgaataggctagctctatctttcaattgcctatcctgtgctcgagaaggtctcccagttcctcggcagcacctcggggtgcatttagttgtcttacatgagactcgggatattcctcaccccatggcaccttttgctcatccattccgcccgcccgtacagacgcggcgccctttttcattatcatctaccgccctttctttcctcccggctattcacgcatgaagatcgtcctatgtatgctttacttcggttgccggtgctataggtaggagtacattatggcaggatcagtcacccgggcaaaccaacccccctccaagaggaattgtgctatgccccccccgatccctatagagcgaaagagctgcctggtgatccctaggttgcagcacgtccggtcgttaactcctcgcgccgttgccgccgtttctaggaccgaccgacgcctcacctgcactggtacctacgtagtgtcggtcgcacattcaacatagcgttcggactcatgtgccttccagaaccagggggtcttcgagcctgctgcgtacgattagccagccttgcggcggcaaaaggattagacgtcccccccccatgctacggttccctgcggtccgaatccggcgccgcattaggttagggtagggggctgggcgataatagttcctctgcatccccaagcgcgctgccctcctaggcgcgcaacactaagtaatccaagccaacccacattactggctaacggcggataatcatatttcttagaggtactaaatacaactccatgaatgagcaaaatggaggttgcattaatgataaagatctctggggaaaccgctaaaaaaagattgaacatgtgtgggaggatccgaacgaattctgctttcatttcccccgtatggagcactgagtcacttacgttacggtcttcagcgggcaggctgcactctaggcgacggctaggaaggatcgctagaccagcagccaaaccaacaatgaatatataatataatgatagtgattcggctcaataaaaaaatgtagaaaagaaagggcggaatagcataattgtccgatttattcctcgatcttctttgaagacttactcctcctttccgaaaagatcgtccttggtccttttgacataagattctcggccgctcaagagactctctctcgtatatatatttatacgcaatatcttgactcctactacccctcctttccgaaaaattgattgagtctttgtctaagcgagttttctaggccgggtgacctggccacttctattgcttatcttttcattacatcttttgttctctagcggactttctgacttcaactggaccacccacccggactaggaacccgaatttatccgcccatccccgtcgaagaaggggcgacggccttgattatgccgggcatgctccccgaaccccacccaattaataagactaagtaaaaaaaaatggaaatagtgaatcaagatctagatggatccctatctttctctctatccacgggatacctatctagatgaaaaaatccatctatgaatcgatctagactatcctctatccggatagagatgtccctatgagtgactacgccgatctttatatgttttggccacgtccgtttctgctccgaagaggaaggtttggatcttttaatcttatgtcgtgagggatatgacctatgttaggtccataagataccacagcttttggtgttctatgattaacctccgaataatgagtaggtagttcgatccttttgattcttctcttcatagtcaacttatggggggatgcgaagcaataggtcgaattactatataaagataaagaagagttgtaaactataggactgattgttcgagtaggaagatttaggtttttatccttccttctcttcgataagaatagggattttaacaaattcctcttcattctcttgtgctcagcgaaggaacttcctaagcatactttttcggatccaaacttctttgttctttctaagtcttcttcttgcatagaagaacgcaactgttgcaaaaaccgggattttagtagtaggcggcatcccctcttagttttgagtaggtggaaccattcagttttgcttcttctccacattcttagcggttgatgcagtaatttgcctatgattttttcaactgaaatttctttatagaaagatctccttatttcttcaccgcgtattatcgcgttattttcttgaaaagatattatatcaccgtgggaaagtttaaaatgagtaatgcttaccattcctttattcacacaaacccttcgatgacttatcggctgccttgcttgaggaatagtttcaagaaaatggagacgaagcggaataacgtcaaatcttgtttctggattgagtggaaaagggatatatgaagttcgttttgttcctctgtgcatctctgtgatgggtaaatccccatgaaaaaggggcaactttcgtgtagtttgtaattgtatataactggtaagatattttttcggataaatctttctcttcttaatagatctcttcctgttcctcaatcttcggagaatgcggcgttgtattattgtcagttctctgttccgaacatttcctgaaagtagacgacaagtttgaaatcttaatggggacaaatctatatctcgttgaatcagttttttaagcagccacattgcgtccctgggactcgaacccaattctgcaacaacccctgttcctgtcctttctttgttttgttgatctattcctcttcacgttgtctttttaaaaaaagactgaaagtatgggctattgacaccatggtcagaaagatattttaggacttttctaagtcccgcttctacgataaagtctttccggttttaataaagcgagcgccactctgaatccacgatccgtaaggatctagctccgccacattttgagtagcacttctttattttttgaaaaggccacaaaactcttttcaaaaaataaatctacagtttttggtagttcatttttttgtgaaagaaagaggcggaaagctatgtcctgtacagtttctcctcccacctgagggcgaagtcatgactcgacctttagttttgtgactcgagtacttgttgcgagaggtactttagtaactcgactaaaaggagaggttgtttacatacttgagctttctgcgagagggatttattactcgactaaaaggagagagagcaaggtgaactcttcccattgctaacattccagggattccagaaccaactaatctaatttcctaacctgggattccttaaccaactaccaatttaaagagtaaaacacttccttgggataaactgattcaaacagataggcagattgaaatggaactttctacaaacaaaaactccttaccttacttggcttacctctcccattcctctaatccctaaccaaaacaaacctaatctcatcacctcattgctaatattgctgggattccctcctaaccaactaatctccttacctcctattcctgggattactgggattactggttctcccattcctaacattcctaggaattcgcaagacaccataggcaacatgggaatccttgatctacttgtttctcagattccctttgaggttaggagagtgagtcgattcgacgaggctagcttgtaggttagcctttagtttccgtcaaagaattggattttcatacttccttcccctttggtcgattcaagtggactttatcctagatttgtcgatttatccctggttgaggacctttggatgccagttttctagatgccagttttctataagaagggtcagccttaaaggaaaaaaaccaatcccaaggtaaggtctaaactgatctaatcggtaaagccggaaaaagagctgagtttaacggcgagaagctcctttcaaaggaaggagtgacagaaaaggtcgggacagtggctgctaccgcattgacttcgtaagatttggatgtgttaaggctaacctcccaaaactcactaaatttacgttgcttcacaaggtaattcctatttgcttacttgttagagtaaggaaaggagaagagcttcaaggtagaacctatgaacgtagatcgcatataatgtgtcgatctcatcaccttaccaaccagggcctatgtatacgaaactggtgcaccatctgcaatcgctatatatacctgacctatcttctcgtgtatcaccctttctttcttcctttcctaactatcactgaccgcgggggaaatgctgacagaatgccaatacttgttcgatcgaaattctaacagttgttccgggcgtttaatgtttgttctggttcaagctagaaaacggtcaagtgtgtttctaatcagggttatctaaattggaataagtactttttgataactttgtctcatgcggagcaaagcccttcttagtcaagcttagtccctttggagtatatttaaagggaagtgcggatctggagtgttttgtttagacgagctatgcagcaagctgagttctatcgaaacaacgttttccgggcatacgagaaaagagtccagcccagcatatttatttgcgactttcttgatcccggaaatcttgtactcagagtcacggataaagataaagtggactaccctgtatgacctacagttctttttagtggctttttcttgtcctggaccattcagccctttctcaaccaagtataggtagaagccctcttttccatacagataaaggttcgacttccaagagaaaagataaggaagtcggtattgatcgtggaaatatcttagaaagtcttcaaaatcgcttctcttccttcattctcagtaggctaccgtcctcggaaccaatgcctaagatttgcccttgcggtctgcccttagtctaaagacttctatccactacgatggaatctgtttagtggagagaaggcctagttaatctagcactatggtggaatctaagtgtaagatattgttccgcggttggaaaactagctcctatgcgcctgtaggtaggacgttagaaaaagaatccgaattaggcttgcagacctactattaggctttcagtgtagtaacctagatgctgaatatagactcccatctatagtaaaagagaagaaagtcaggcggacactggcagctgcaagtcagtcggttggcttccgtcacttctataaaacgctgcccaacagactgaaatgactatcttcgggatatgatgccagagttggtgcttttgcggcatctagttcagtatcagaggcgctgcgctgcccttggctaagaaggtttacttctctgtcacttccgtacttctgtaacttctctttagcttattaatggaattggttagaaagtctttccggctagaagagagggattagtacacctccaacactgacttcttagtcgagtagttctctttctcctgggctgagacgtgacctcttctcctcgttttcattgggagggaagatatagatacaaaggtaagcacgaacggaagtattcgaaagagctatttagctgaaaactctatagctaaattactctatcatagaagccattactgactgaatctgggagggcaaaaggcttagtaatagtaagcttctcaaccctggtaagggtttacttcgtcccaggccaggtcgttgctcgttgcacggtaggcggctttgaggaaaggtatgaagtcactcgccctttagctttagaaagcaggagaggtgctttagcaactcgactgaaaggagaggttatgaacacaaactcgactgaaaggagaggttgtgaacacaaactcgactgaaaggagaggttgtgaacacaaactcgactgaaaggagaggtccaaggtaatttattactcttataaaagagggaactcgactgaaaggagagggagagggatttgactttttctgtcaggccaatttctttctagtggtaagtgctttcagccagttctagtccttttcttatacgcttattggcgttagcacattcctctttcttattggatggagttgttttgccacctggagttttaatggaagtttgagtgcgtcctaaaagccaatgcttctgccttttggaagtgtctgcctatatctgtcctccccatttaatcagtctctgtccttaccttcgacggtaacccctttatagtacagcagtcccgtttccggcagtgccttccccccccctagtctagaccgagtatcaatagttgtagttcctgtccgttatggacccttcgtatctttcaaatccaatcaatgtgtggtgtgtatccaagggcaaatgcaatctctgaatctgttacagccattgtagcactaggtgcctacccataagcagtagttgcccttgaatgtgcatcaaatcctaagacaagcctatctaatctcacttcttagtctaaagcactcaaatcccttctaaggagccagccctttttgaatccctctcttttcttcatgctgtgaagaaattttccctatccccctaactggcgaggcttcttctaaacgagtggagttcagttagactgccccttctttctcgtgctctccgtccaagcgagctaactcctgatctcctgttgtaaagatctccagaccaaggctattcttaccagttgacatccatcccgttgcattcccagcggttttagttctattggatggggttctatacgagcgttccataccgtctcttgggatcaaactgaattaagttggactcccttcaagagatagatttctttccacgataatatctatattttcttaagaaagaagactagaatatcattgggagtgcacttaagccaattggagtactaggccttctgttccagtgacagttatagaaaaaagcgaagccctccactcataagtaataagtaatttcatcccttaccagtccgtcctaccagctcttctgtcttcctttttaaaaggagctaacgatacgatgttcaagctttgccagaagccttttgcagagagaaagttcgaagatcaggatcaggattggattgaaaataaatctcctcagcattcaattcaagtgggtctatcgatacaagtggtaagaccgataattcagcatccaagacctggccgatgtctacttcaaattcaagtgccacttatcttaacacaactcgggctaatcgactcccagcctatcccgacctggtcctttcgaaccagtctttataaacctggtgaaagcaatcaagcaggacttacctgctgggagcccccttccttctattccgaaacctagaagtttttttttccagctcttgagctgattgaatgatttttgttcactgctaagctaatccttctgtcctactttactctattatgagacctcaccctaggctagggagctggtttaagccatgcccttatttgactcccaagaccggatacatagctcttctgagcgggtcaaattcaaatacaatgagtgcttagggaaagtaagaaagaaagacataaagcggaatccggtaatcctactgctactaagactactccgtcttagggctaggagttcaagcgcggcgtaacgggggttgtcagcgtaacagctggtgctctaatctgagctgagaaataggaactgcacttcgacttgatttatttatttactatattcccccctctctaacccaagtcctagaagtgaatgaggaatgaaagaacttctgcttccgcaatgagacgctaaagtccttaaatcaaggaaatcacaatgcttctcttattcagtagttcaatcttactttcttaccccgccggggaagcgttgaatgaatgtgtaatgatgtccatcaggggagatcttgaccgatggccgcgcgatgtccgagttccttcgaatgctttttccaagccccttcttgcgctttacgaaattcgttgttaaggccagtccttctctcaccttcacagaagaaaagagattcttctgaatggttgatatattcattccagaggagatgccggtgaagactaccagccaatgatggacctgggcttactaccgccaagtagcctattaagtctcaaattgagtactaaagtcaaactacttgtcctccccaaaagagcagctgaaagaaacccatggcaaagcaacatacccgtttaagcatagtcgctcgtctaacgtttcgggacaagaggagaggaacgcctttgagatcaggatgttctaccgcttttcctagggaaggtatatactactgatagtattccgctttgtgaaagtgccataaaagctctcttcgcgtcaacgacatccatctaaccatctaacgagatatgcttcgggtaagattccctgatctgaaatttcgttagtgagctggttcggtctatcccttcacttaacctaaagcgtacattcgatagggaactttgattatcaaatgggttggtttattagcgcactcacgccaagtgctaccggctcatcctggtgaggcatcccaagcccctgtaatatttcgcttttttcgtcctctcgctttgtccattccttgatctacgaaaggtattcagtattaggatcagaggcctatgggatttcagtagcctttaatcaattacaaactcatcactcttcttgaaggttaacttcacatcttgtgtgtgttcccttgatgtatcttaagacccatttcacagcctgccaatgactcctcaatggcttactcatatatctgctaatcactcctactggataagggtaatctggtcttgtaccaatcattgcgtacatcacacttccaacagcacttgaatatgggagtgatttcatatagtccatttgttcctgcagttcttcttctgtagctgtttggaatctgaagtgaactcccaaaggaggtaggaaaggtttggcacaacgctcataggactatcggtgtgcggagttcatctcttggttagcaaggaaagattcttcaaccagacatctcccatttaatcggaacagaagtaagaaatctaatatcagtacggaccaggggaaaggtgttacaattgtagcatcaagtgcactcaatccggttgttagtatttgttaggtcttccgtgttaggtcatctataagacttagaaaatactgacactttcaaaaagataatgggactgaaggtgctccccataaatctgaatgcacataatccagaggattcttagtagtgtgctggcccgtagagaaattcactctatgtgtctttccatagatgcaatcttcacaaaatttgagacttgaaaccttgctgctatctaggaaacctttcttgaccagtaactccattcctctttggctcatatgtgcaagcctactgtgccaaagccttgtctcatccttagctgtttctgcaaggttagactctcctgtttcaacagagccttgaagaatgtaaagtgaatcatgtctgttccctttcagtattgttctgcatcctttaagaaccttcagaactccttcactacaacttgcttcaacgggccggggcctttcccattctttcgaagttgctagcattctctctcctttgcgcatgtgtgggaataaattgactccatctgtctctgagaatgggggaaggccacactttgttctcttctctctctctagtccaatgtccaattaaacctaaccgatcaaccctttcagtggtccaatacgcgcgctgtagggcgctgacacttgggtcaacgatgattgtacctaaaatgagaagagaggagataaagaaagagagcgtattgaaactcttaggtgaggaatttggaagtactttaaggcttgacggagaagagagagatgagagggaaggatagcagttaccgagtaggagtagttgatcctcacatcaaaatatgtttataagaaagtttcctcattcaagtgagaaataggataaaccaccgcccaaagttgcttagccaagagtagtcctatatgggctcgcgaagccggtctccggtgggaaagatcctatctaactatttgggagaacttctcttcttttctttgattgtgctttgcttaacacaatcgaagtgggatcatcgtggagaaaaatatcttgcggtcagtctttccatatcttcttctttagctcattcgcaacagtttcctccattcctgcgatttcctcaggattcctcgcttgttgtgatagcaatctataaccgctctgtaccgtgtacatgccactcttagtgtaagcccacacattatcatccataagatttgcccctggtatcatcgagatgataaatgccacattctgtggaggaaaaatattatgcaacatatccagtttccacgactgcctattcatgtcgtacaagtcagacgaagattaaggtcaatagataggtttcaattcagtggaggtagaggtgtctcatccattatccatctgtctaaccaaaccttcgtgtgtataccgtctccaatcgtccttaggagcccgcgagagaggagttctctgccatgaatgatacttctccaagcatatgaaggtcttgtcccaacactacactccatcattgagctatgtgggaaatatcggctacggagaagtcgagatagtagcgtatgtggttggtgtataatccggaaagattgttttgcaagaagagcttggttaaaccaacctaaatcccgaaaacccaaaccaccatcatcttctttagatttgcataatttctgccaagctacccatgagatcttccttttgttttcgcaagaactccaccaaaattccgtcatcgcacttgttaacttcttgcatagcagctttgaaagccggaagcacgacatcgcatacaccggtaaggccattgctatagatttcagcagcacctcctttcccccctgagatcaaaattttgcaaaccaaccattaaggcgggattgaagcttgtcccgaatgaaggctaacaacttcttattttatctacaacagcagaatcgcagcaataatcaacagatagaaagaaatagattagaggagagggtaagggtggatagggtatggacagccgtagaactcgcgaagcatgcattagaagcagatcctactagggtttgttaacctactcggcggggtaggagatagatatgttcctcgtagggatgacctagtcgaaggaaagaagatgttcccaaagagatgttgaggaaggatagcagtatacataatcttaatgcaatcaaacggttatcctcctttttataggtatccaaactcggaagatgttatgagactgagccggctaccgtacttcgtgctggaacaggggtgactcctaacaatggatccaccacagtaggggttatatcacaacttattaccatccggacaaagaaaaggaatagtagtgaaatgacaggaacgacagctttcactgctacggctattggctttagctatactatggcattccctgtagttcttggagtcactcaaactcgaactcctgttacagctcggctatagactacgcctctattaatcctttgttcgtgatcactcccagcaatcacttcactggctaacagttagttagaaagtgttccggctaaggcctatagaactcatttcactccggttatagctgaaagtggctttgttcttatcgttcagtggtcactctttataggtaagtaaagaagggattctattatattccgatactgctacgagctgtcttaactccacttacttctaggccattagctcagtaagctcagtaactccattctctaatgccagccttacctcaattcccttcttagcctcaacagctaaagcatccctttctacagctcctgaaacagtcgaagaaccacaggcctaagtaagtgttgtgttcaacctttctataagtaatatgggttggctggttggaaggacagctttatgtcgtaagtaaatagtcgtcaactatcgagaacctgtctgaagtgttattccagcgcttcctagtctttacatagtctttttccctataatcaagaaacgtctctcaagtcgtgttccaaccagatgactccatctctctcttggactgtttccttcatcctcagaataggtgtctgagggtcttcatctccgctggaatctttacttgcaatttgatcaagtcagctatccaaaatgagttttcattcaagaaccactttactttgagctcgtagcggaaagagcagattaactttcagtttctcatatggagtcccatatgcttagccatcagctgagaaagattgataccaagtcggagcatatcccgttcgagggtccacctattcgggagccagtacgagggtcaattccagtttcggatacctgcgcctattgcatatttagtatttgcagttcaccccgctgttagataggcagagtaagcataggctgtggtataaatcttttgagtttgaagatattttatcgaccggagcaagatccattcataagggtttggagatttctcaatctaaaaaatcaaatacgattcaacagcgggagagatcagcattgataggacatggagatgtgggctcagaagggagtggaatagagtcatttgatagcttagatgccgccactagagagaggttcacttgcttaccttgccgggtcaccaggagaggttgtgcagaacaagaccaataacccgatctctgctaaggagcaatacggatcggataagagaggatccatcttctcgggggagtctaaaagaagaccaccacttccatacggaaaagtgtagacgatgatccgggacttttcgatcttttttctgttacctaactcttcaatcactctttcttaggcggggacaggattcgaacctgcagtcttcaggtcatgagcctgatgagttttcttcctctacccagcgtcttccccttctctttctttcacaattcccacctaggtcccccgctttgttagcttggccgggatagaagctgcgcttagtaagcgccccttgtcttgtataggttggagctatgaagcttagccttcttattagaaaaaggtatgaaatgactcgactaaaagaggaactttcctttgtgaacatttacttgcctttgcctttccttcccgccttaagaaaaagaaagcccggatccggataagcagctatcggcttcatgccatcttcattcatttgtccaattccgggcactgtaagaacctattctctgattcaatcaaatatcccaaaccaaaggcctatgaaagcccgctcaatagcaagaaggctttttcaacgattttcatgcttccttcctcgattgatgaggccgtcggggtgccttttgtgctttgcttgcctgttagttttgcgtatcagttactagctttccttccctagcttgaagttcagttcttcctttccttgggtcattagtggcattagtttgaaaatgaatatcagatcatctgtccaaattgatggaggaagattctttcacagcgcattcaattcctaactattgtgacgtagcccgatgtagtgtgaatcgacctttcttcttcttttttctggagagcttcaatttagctgtcatccacggagaagcttcttggctctagcctcatgtctcatattctttcatattctttctcgttggatatggtatcaacttcaagactgcagacatgaactcaagatcccaccaatcccttcttcttgttatatgcgacgacctaccgaagacaagagatgattagctcctttcttattggattggagaagatggctcgctcacttcctttgtgcacctcccgctatcgatctcatttcttcccttctaaaagaaactgaagaaagaagtagagtcgcctaggaagtaaagaaagttgtgttggttctttccctggttccttgttcccctgttgccctaagagaaaggctgttgtgattctacggtttagagcatttccaagataggcattgttagccttgcgcttgaacctacaaggaggaagagatagcaaagtcttatcttatagggggcctcgaaatcagaataagttgaggggagggaattcaatgaatctgaagcatcagatagcaacaccacaggataatccattcctactttagaaaaagggaaggcgtgagggtaaggtaaagtagaatactactcaaaaagctggtaaaagaccttggttgatcgggtatcgaaggaatccctttagtttgaaactaatacccccttggaaattgatttgatctggctacgtatctcacttcctcagcaaccggtaaaaagtagattcatcaagataggaaggaaagacgcagtgctcctgtggtgaaactgcaggataaagataggaaaagtggtgcttgtcttgaaggtgaggaagggaagaggaagtgaatttgctttgggtgtgggttaagctcttccttatcttaggacgaatcagcagagaagggccttcgcttcgaactcggatgtttaggaagaaagctgtccacttgaagctgaaaccttagacttcctctcgggctatctatgaattagaaagctaacccttagatccgggaagagggaactggcagtaagggtattacacttcaagaaaagtggaactcactcgaatagagagagtctaggctcactcacagacccagctgtctttgctttgttcacaacgtcagcccgcaagaactcaccctcgtgtgaaagatagcaagatgtggttgatggaagtaggtatgtgtcataagttcaggcacagtgtcttctaggaagaaactttgtgtaaggatcttttacagtaaagcaaggtattgatcaaagtgacagtggtgagggtaaccttgtgaaaaaaaaaatggttaggtgtgccctttcctatggtgtctcttctgtgttagctagtataagtcttagtgcttttgttttagtaaggtcaataggagttagctggtagggcaatctctcgtgcaatcagaataatccttgaaccttccacccggagtttcttctttcttcaaagctttggattgaaaacctttgcttagccttataaagtagccaattttccaactataattagaatgaatgtgaaaagaagatgaaagaatcgtgtgatactatagctagctacgatcccctacaagaggaatcactctacttacccctttggcgggcttcgaggaccctactgactaattctttatgcatggatgcaggaagagcctacgagttcatttgtaacaatatgaaagaagaaccttgcgtgcccgatcatgatataggtacagcttccagccagaaaggtgattgtgctagaaagatggcagtgaagatcatggataaagagctagtcaagcagcatcctgatgatatccacgtaccaactactggcactgctagtgcttttgtggattaacctacttcccagggccggcggtcagagaagaaaagatctctatgaaagcaggagacgggaaataggctcgctcgattcgatggtttagagtcccgtatcatatggcatgctttccttagaatccatagacaaagggcgtacggtaccctacgaaatcggcagatgattgctttgattggcctgctgtatcagtttattcgactacttcctccataccgtagtggacttccttcctagatagatgtaggagcagcggaaagggctgctttagaagcttcaatagttccctcatcaacggatggtttagccgccaggtgatagggatgtcaaatagaaaaggcaagcaggcgtagaaggccacgttcgatagctgaaaagtcaagctgcggtagagggtgtaaactaaatagttacagctgggcttggcaattatctagccgaagtggaaggttaaacgggataaaatcctggtcattctatagttgcaggatcggtaaatgaagccggaaagagtatctagagataaaagtccaggcgtcgaagccaattaaacacttggacaagatagtgaagggtctggggagaagtaaattctagagttcattactcggatggggactacagtaaagaaatctattctagaggactaaatgtcaacaaactttagcgagagtaccaagatcggactcaacttcctattccaaaggcaactttactagcgtggttatgaatcaacttacaattcttgtacaggaggaactgttaatgaaagacaactatagtagtaatagctgtgaattccacttctgagttagagttcaatcctttccatctgaaagtacgtacttcttatagcttgagaagaggaaggatgcattcgtcagcataggaaggcccaatcaaataccccatcatagtataagttttccctcttgattgacttgaacaaaaggaaagaaagaaagatgcacaaacgaaacaggaaactacgaaggtctcaggagcaatatcaactacctagaccgacctgctataagaattccataaagaccttgcgaagatactgtactgaatgactggatcgtactagatagatagtcttagatagacttgaatacgcaattcctgccaatctcgcacttgacacgcaataaacagcagtctatcttcacagagaaggatggcaaggggtgaaaggcttagaccttatctgctctaggctagtttcattctattcttgttcagcatatttagtttcaaaagatagaggtccggaggcattaattagttgatgaggagaaaggccagccacgaaacactcacccaatcaaccttcaaaggcaagtaaggactctctcaaactgaaaattgctgttcacattgcaagatctgtctcaagatgttttgaaaatgagaaacagcagcagaataaatagtatactttatcgagaaaagggaggaagtatcttctttctctgacgtagacgggcattcctatcgagattacttccttaggaccgggaggtcgaagaatctatatgctaccttactttcaggatggctttacgaaagattccatttagctgaagtaggacgaagcggtatgagataagaggtctcaacgagccttcagcatctgaaacgggagctttaacctgcatatcatacgggagtcttagtggagagcgttctctggttatcatccctagttaaatttgaagtgacggaggaacccctattcgataaagaagggaacggtgcaaataaagctatttcgagtcctctatcaacaaccaaccaaaccacccgcttgtcgggcttaaagcgaaactgagcttctcactaacaaaatcaatcgtaagcttcatgtccgagactcggaaagagtggcgttaaagagggcgtcagagcctctcgaagtctccgatctcacagatggttaggctgcaattccttcgcttgtgaagaagcttggatagttctccttactcggacattctattcattcgaccaccgcccatgcttaaagattgaagttttgttttgactctgtaaaaaaaaagaacgttgtaacgtcggttaacgcagcctcacaggcagcctgagaagtttttgacccctttacctatcttgggtgagctacatccatacatagtctaagcctctgattgacagtactagatacggaatcttagtcccaagagttctgcggaagcgggctaaaggcaatagttcgctagggtggttatcccaattctttgataagatcgctaccgaacgcccccaaaagcctagtctttagaaggaacgaacggatttctttgtttgttcgtgcaatgaagaatcttatctaaagaaggtaatacggaaagaaaaaaactcaacctgatgctactggaatagagaagcaagcaaagtgggtcgggctggccaattgaaaaaagcggtatttcttccgcgaagactaactaacggggcgcactcaatttctaccttccccgagcttaccaccacccgtggtacaatagaatgaaaacagagtaatgaccaagggaatttctattaaccaacgggagatcctccttttctcgctaatctaggtctcagggttccccagcacagacttcttgttagtttaaactagtaaaatgggagtgaagctatgctgttaaacaagacaaaccaatcgcagatgtactatcatgcgaggaaggccccccattattgttgaaaaaggactattcctaacacgtctttcgtctaatcgggagaaaaaaggaaaaaggcgttattgctgtgcttcccttccctttacaggcaagctttaacttcccttcggggaaagggaaagaccttgaaaactctttccgtataggccagaaaacagcttgcttagagaaagactgactctcctacggacctggtggaccttacacagtcgagttattgcatccctctcacaaactatcaatttcataagagaagaaagatcgtttttagaaaagaaagaacgttttgattcgaggcggatcccttttttctttgcctttacgagttgaaaagaaagtggtaacaggtagtagctctggtagagtgcaggactgtaaatccttctgtgagcggttcgaatccgcaatcacttatagttagtttcatcgatatttttgtggtgttcagtgtaccctgagtacaagatcgaagaggatcctcattccctctttagtcaatcccaatcgaaaaatcagcggagccaatggcttgatcataatgctgcggcggggtcagagagccggcaaaccgtttctggttctagtagaaagggatttactgattcgggttgaggatgacgagcaaaagagtggaggaaaagctgttatatagttagtctatttctatcttcctatctttgtcatgtcagtcttattcctatcttggtatctttgtcatgaggtatgcagcacactcaaccaaaatatatagaattggatcatcaacgggtgtgctaaagaaacgcctctacgtaaacggatgaacgggatcatcatatagtgagcttcgtttgggatacttaaacccacaaaaattagctctttagctgatatacgaccaccaactatctggctatcgagaagatctaatatgcagggaagtaattcaatagaataacgcaaggttcgataaatcaattgatgcaaaagcagggaattagaccactccatcctttatttcacctaggagccatcttagcagcagggctttcgactctcgaatgtcaaagaaggtccttttctatcatctgagctttctcacctgtgccctcagccctcaagacttcgccagaccttgattttcgattgaagataatcgttgcttcgctatcccgataccaaaatgggaagatctcccttctgggttggtagatgaattgttctgggtaacaggcggtggacatcttcgttgacagatctgagttatcgacttggtcatatgccctaaagttaccctaagccctcggggctccatccgaacctgtgactcaaccttctctttagcggaggagaatagttccgagtgagtgtgctcccgaaccaacgatttgtatactctttgccccaggtaccaatacccatgtcttcctgcttcttttgattctcttactcttcaaaaataaaagcaaagcacaccgctaaacaaaaagctggtattaccaaccttctcagaggttaggcgattcattgagtcgatcagtcatctttttcccaagacaactttattgtgtgtaggcgcacaaaggaagatcgtagaatcaggattactcgtccactttcatcgccttttgttgatccgtgtcatccttgctgcttcatccaattattctttattcctcctctcacttgggcgaaacactagaaacggccattaatttacggatcggtcatacaaggagcatacctactaatacttcggcgtgtgctgcattcgagtggttaacagcatacatctattcccaaatcccaacggagatagatagtatccttctgtgctatcccctatatcctcgtagtagggttgagggcagcgaagtctcccgtttatcctgtctccttctcttggttagtgcgtactacttcccaacgtatcttatatagagacattggaggagcctgatcttccatctacgcaaaagagatgcttgagttcttccatccgcgaaggcggtgtgctcaaataagttagtttgttacgagactatcaggtccaccaggataattcgaggtggatagccctgactgacaggggactaagattaggaagcatccacaagagcgaaagagcccttttatgtttgtttcgctaatcttatagattggaagtttgcccagcacagagtagtagggttatgctttcgaaagtcttttcagagtataagggaggtccatctttagagatctgaatgaaagttctgagcttaatggattcccggaaccccaggactttagagagtcccaaccctaagaaggcttgctcgggttgaaagatgtgatgcagcacagacagaggtgcgatagtaagtcaattgatcaggagaggtggtagcttctggtctctcaagctgacaatggtagtctagatagatataaagttctatgctgtttgcttgctcaaggctagaagcaggagtctgttattgatagctcccgttgccattggctgttccgcccgtggtctttcagatagacgttcaaaataaaattcttttcatcctctcctcctggctaccagtatatggagatggtttgattctgagagttgaggaacaccaagcaagatttgattgacatcatctacggctttgcgccaatatgaattatgaatataggttaagtgaaatctgacaaccagcacactgcttgatctcattagcagctccggcgaagcagcacagaccaaggtaagcacaggataggcagtatctttatgaagtctcgtaaggctcagatctttaatagaagtaaacttcaggtctttgttctaataaatagccatcttcgtcctcaatggcaagaaagaaaggctgctaggagtaagtgggaagtgccagggtaaagcccctgatggatcgatcaacggattctgcaatttcatctctttcataagcgattaattcttgtttagccttagttgggatttggactcagaagccgaacacagttcttagatcgattaaaagcatgccgcttatcgacactctttttctaaggatcttaggcagcggttgaagttaccagggatggaaccataggtgctttagcaacagcaactcgactattagaacatgcgtacgtgaggagcaactcgagtgaagaagcaagttatggtgtattgtccaatgtgccccgcttttctccatgctgaggactattcgacttgtgagtcagattccgatttagtggaggaacttccttttgaaggcacccgagagcctatataagatttaccaatttcctcagctagatgatcaaagtcttggatgcaggatggctccaatctgacagatgtggcaccaaaacctaaagattcctttactagggtttggtggaatgatagcccaaagaagatttttggtgtagaaagtctcaaattcaggatcttccgctgtacggatttcctgggaaacgaagtcataggcacgtaggttcagagccagaccgatcactcacaatatccctgggcaagccaaagattttgaccacatgcttaaggaacaactccgcagcatcatggacggtgcatgcatgttgcgctgctatgaacacagcatacttagaaaagcgatccaccactaccatcacggacctaatctttttaggaatggaacccacaaacaaggtcttgaagagccttgtgttacctaactaaagagctcccaaggccacctgattcggagtagagcactcctatttacacttcgattccgcccactgattcagatccagctaaggcccgcaaccaaagaggagacacttgcaccggggtaatgctaccacacaggttttgaggcgaggcgctgccctctttcgggcaatcaactctttcttgtacctggcactagtcaaattgtatctcggttcatggcatgccacaacgactctatcggcttatagtcattcctggcactcggcgcatgtctttgatcaaccccggttccgtcactcgtatctggttgaaccagtacttcctttccgccgttcctagggaccacccactcccgttcccatgagtgatccgagacagtacgcggagattaatcggtctcttttggttctcattccaaaagttgagcagcctgttagcataaaaatggcaattatcctccttctattcgttctggatacgggcctagtcctgagtgcgctgtctgtcttctcggctggcccaaacaacgggattggtcctgtgggattagcaccaaaattcctcggcatctcatcctcctgttgctggtcatttcctaaaggatcgaaggttcagccgacgcctcaaagtggatttgttgtgcgaagggtgcgaccgggatttagagttagaatagcggggaagacttgacctcaggcagcgtgaaaccagtttatttcattcgatgtagtggtccgattgcctagtggaagccctgaggcacttgattcttgcgtacgctcggctcctctaccaatcaccacagcgcgagatgcgcaagagtgacccatctctccacaccaactggaccatacaatacactctttataagaaaaaaagatttggaaccgaaagataggaaataaatttacttccagagcggaagggaatacttaaccacgcctcgagtcccagtctcctagtggtgagatggtaaagggcaatgtccggttctggccaagagatgtctttgctccgtcccccttcttgttggttggcacaagcccttgtagtagtaagtctttcctccggccggatcggatgttagagtcaattccattgtacgtttgaccattaagtgaatgcaaatataggtagaatttgaatcaacgacctaagagtcttcttttgcctatcgtagttaccttgatgtgataaatggtccaactttcttgaaagatatcagatctttaaagtcctgctcatatacatactaatatgatcgctacgaggtcatcccactacacaccatcaagcaaccactactgaagctatcaactcaattctctcgttcgaatggggagatagataaaagaaacgaaactctataaaatatcataagagaagaagattttaattccagcttaaataagtaagacttgactctttaaaaaattccgatcaacaacttggagggatggctgagtggcttaaggcattggtttgctaaatcgacatacaagaagattgtatcatgggttcgaatcccatttcctccggcgcggaagtgaaacgggcgggcgaaatgagaagagcactacttagtgactaggagcggggagcccgttgcgcgtttttttgtttgaccggcctatcttcataagtaagctccctatggccgtccagtccctgggcggctctcggttcttgagcatgttgggagattagtcgtcaattgaaagagctgctctaaagcttgacgaagaagttttccctattaattagattagtaaagggcttttcccttactagtcaagtggtaaggtagggcgctcttcgatgaagaaaagaagagacttttggaaaagtggttcagctcagctggttagagcaaaggactgtaaatccttgtgtcagtggttcgaatccacaaccacttctattctcggagctgaggtatatgaagaatggccttttggtcctttggacacgtagccgagagcgagccggatttttaaaattcaagtgaaagaaggaagaaggcaaaaagccgtatagtgcaggaggcagatgaaaaaaaaaaagcaattacagtgagacgcgaggtgtagcgcagtctggtcagcgcatctgttttgggtacagagggccataggttcgaatcctgtcaccttgattaatgtctttttttttggaacctttgttttggagttttcccaaacctataccttactcatcttactaagaaaatggggcttatgtttttcagccgcatcgcactgctgcataaacaatagatccgctgggctggatgagcaaccttctatctggcctctgtactagtagtagagttgcttgctactttcaatcataaaacgaaaattgagcaaggcaagggagaaagaagttgtcccctcctctctggtaacccgccgccggtcatatagagcgctccgcccgccccagcatatgtataaaaaagagggaagaaagaacaaccgttttactttggcacatgaggtggcgggtttggctaggtaacataatggaaatgtatcggactgcaaatcctgtaatgacggttcgactccgtccttggcctacaccttcatgaccagaaataactggaacaaagggaaagcccactcaactagtaacatacggacacaaacaacaaaactacttgttacaaataacatcttgttgttgcatcgaaacatataaatgtttactaatctggctaacattgaacttggtaaaattaaatggttgaataatttaaaaattagattattcgggaatacacattgaatgcgaagattacgcatttcatttctggtagtagatccataatcaaaaaagtgtttgtgattgttccagaagaagaaatgaaacaaaagatacggtagagctaggacagttattgtatgaggtctacccaatgctaaatgcagaggcgcataatagatcgatatgaacatcatgagctgtcccgcaataaaacctgttgttgctgatactttcttctcggttccttcttctccttcgtccataacccgagctcggagaaggaagagataaaagggccctatggagaatgtggtcagaaatccataatagagtccgaccacaacgaccgaattgattatcttcatgcataagtatactagattacctagtataaaagattgaaaaaccatcacaaacctcccctttttcttttctatttcaatttatggattattatatgatgattttgcaactttccatatatagaaatagaaagagatagactagaaacgacatctcttatgtcaatgacaccaaagggatattaaatgaatggaattgggatatggatagaatataatgaaataaatagagccgctttgaggttccctatgaaatgaggcatggaacggagccactacgaagaagttccgggggttacgaaggaaacttcgagttcatattggtcatgtgggttgagaacgggaattgaactctataagatctaatctcccattgttcctcagtagctcagtggtagagcggtcggctgttaactgattggtcgtaggttcaaatcctacttggggagatttgttagttatcgcttttctgacctaacggcccctgtccttctcctttgtttctaaactagctgaatcgtgtcaaaagtggaaagttgattgttggttttgattcctcactctcgtataggtgaacttggttcgttaaattcttaggaagaaaagaaggatcaactgggaatgaatgggaagactggagtagtatctcttcattagtcggaaggaatttgtctccactagcctcattcgaaaaagaacagaatccgaacaaacaagaaaagggtttaggtaggatagtgcgatgtagtccaatggctaaagctctgccagcttcttgtagactgaactctctttaggctcctagtggttttcgggtgggatggttgaaattttattcgccactagtggcaacgaagttcttggtaattttaaagggggaaggcttgcagaccactcatttcattcattcagtgcctgcggtgaggcgcgacccacaacaaaaacaaagggggaaagcttgcttactgtagccctcttttagtagactaggcttggtaagcgtaagctatttaagtaggctcgagaagggtagggctcgcagcttcgccggaagcgacgaaggggggctggggaaggccgacgactacatgagggggaagctgtcgtagaagctttgtcccttgctttacagagattgttatgaattgactaaatgactagattctcccggaacgctagctaagctaagaaatagtattagttcccttcaatcaaatcaataagtttatttttttattgattcagggaaaaaacctccttcttagaacccattgagggggcctcggcccgggaaggggagagtggccgagtggtcaaaagcggcagactgtaaatctgttgaagtttttctacgtaggttcgaatcctgcctctcccacttgttgtagttttagcttgtatatgtgaaaaaacgagattttctttcatagaataactctttcacataagaaagtggaggcaggcttggggggatacgatctaaaatgattccacatgaaagaggaccgggcaatcgccctcttttttaatgaagaagcgggctagtccccgaaaatgcccgttaatcaagcaagttggggaaaaaatcttacctattagacggaacacgaagaggtgaactgccggaacaggaggacttaaagctgaggaaacaggaagggcagctaagggaacttgcttcggtaggagtgtgctgaagttggcttcaaacaaagagaaagaaagtagtgtgctgaaggaaagaagaaagagagaaggttaagaagaggatactggcttcgtaagtaaagtatctgaagatgagatagatcggagaggtgagttaccagcgaaactattcactctgatgtccatttcctgcattttctttgtgccgatagaggatttaatatgtagattcctttccttattccctttctggtaaccataacacgtccctgcttttttctgtcgttgactgctagagcaagaggggacgacctttcctaccttatgatacactgaactgctacggcggctttagctctactatggcagaaggaatcgccaactttcatttcatatagctgtaaaagttagcaaccccatttctaagggaaagagcaatctttttttgaaaagtttcatctacagtcaaaagaaagcaaacctcggcagcacagaagagagctactactattattgcatgcgtgctcacgtgtaagagtgtgctaaataaggaaacttcggtctaatcctcgggtgtgctatcacaaggaactcgtccggtgtaggattgtagattacctgtcctattcagcacactcctccattacagcacagaggattagctcgggttaggaaaacaagtagctggtcaaagcatcggaaaagcagaggagtgtgctgacttcaagtagtagctagtcaaccaacttctgctcaaccctaggaacaaggaaagtatcagccgataactctgttcacttggtgtgggattcctaaaagtgtactattatcgcacgccaaagagtgtgctgaaaagggaatagttggttaactaccgaagctagaaacaaatacctgctaaaaccaagggaagcaagagtaggaactacccacccaggaatcagcattctaaactgcagcacaagcacaccagcgtgtatcaggggtgtgctataaaagatcacagctaaggttgagtccttaccttcttattccttccgtagttagcagaacatactagcctggcttatccattcctcgtatttgaggaaagtagggtttgacatcccattctcggatgcacgaattatgcgtttaatcccacgcaacaaactcctctgtgctgggttgtgatcttaaaaaggagctttactgtatagtgttacagtaggaatacctactagatcgaggattcggaacagtactatcctgtttatattgacattcttctgttaagatttcccgtttgagaaaccctttaagatctgagtatctcggaattgaaaataggactttatttgcatcccttccatttcataggaatacagctaaggataccatcagctcgcatactatttacgggaaacagaagtagggcaaagaggaaaagagcaactccctctattagaacaatattctcgaatcgttgcccttttattcatgaagaaagaaaacacatcggtctatctaaagcaacaaaattcgttctatctttctttctctcctattaataaaactggacttctcctctgctcctatcttagcgcgacggagaagccagcactgagagaagacctccctttcaaagtccatcgcctgcacttgaaccggatacctactatttattttattgaactagacgatcagcggacttttatatcatatcaccaacaacgggtttcgcccacagtacagagatgatctcaatcgcatcggcataaaggtccggattccacttcaaaaggatttacgcgcgaattcaactatagacaaaggtccggattccacttcaaaaggatttacgcgcgaattcaactatagacatatctctttggcgacccagggacggggattcatcaatcccggggttcgagggagactttagaacccctatatatgagtctcgaaaccattatttatacatttctcgatgacagagatcatctttaaggagaataaacattggtcctttatttaataaccccgatattatcaaaaccatgatttccttatttctcgatggcataggttccagggaaggaaaacagtccggtcctttttcaccccgaaattcgagagtagccgtataaaccaataccggcagaaccacccaaactcggctcaaagcaggaacaaagacatctagaaagcccacatcacgtggggacttggccttggtgggacattcaaccgacatacacaaccaaataataataggttttagccatgtattccgctacaccgccctattgatctacgctttcgaagcaaccaccggtaccattttcacacaacagagccgacttacttattacatttataggacagggaaccggtctcggtaggacttccaaatcctacctcaagcaaccgacatctctttacttacttgaccgctagccaggggcttgaaaccccttacaaccttccttgcttgccgggcttacatcgctatcatcgctagccagggactggaaatcccttacaatcacatgcctgcgctcgtcgtgcctttaatacttatttattaaccaaaccctccttggccccaattggtctaagactcaccaacatcttacgatgagacatcgggctacctggcaagagtcaataaattggtgaacctatgagagacgcttctaattcttttctttctcctgacactcactatcctacccgatcctgctaacaggaaatttgatgaaataaggaaacttaggctgttgttgaatcaacttagaatacaaccggtacccacgtcgcaactaaagcactcgtagcatacgttccatccacatccggccagttgaagtgaagatcgagaaaatgttcttcaaagcttgctaataaccaaaaaagaattggactcgtgtaagggacttccttttcaagctagcattttagaccaatgcaatcgagtgaaagtgcttcctatcatttgtctgctggaaaccttgcattgagtgtgcaccttgggaatacttgagtttggaggtcttcaagcctttctatgggaaaggtttccaatacgtattctgccgttgtcgagcttaaaagcggatgatgatccctaatcaagagtttggtcctagcttttcgatttcattttgagttctgtcctcgcaaagatatgaagggcgcttttccaggacggatacggatacaggtgacccctttttcccctttgctttctttattacttctcgtacgtgcccagtctcaacgtcacttccaaaaccgcctttcccagatctatgaaaggtgaaaggttgaaggtccacaaaaggtaacataaatgaacaagtttattttgtattcgagctgctgagggccggagctcgtatggatacattacttcattgttctatgaggccttgcacaaagcccatactcggataaggatcgcgaagtgcaaagatccggtctttgacaacccaaccgtcgtaaggacaacaaaacctatacttatgtgtgttcgacactataggcgagaccagttgtcagatgatcgccgagtggcgttctgcttgattaggcgaatgcgagtgaggtatctaatcccgttcgctaggagggagactcaggaagagttcgggcagaaatagatggtgaaaagccctttatattatataataaagcgcgctccttgcatgactccatatcattcattattaaagcgaaagcgacaacgtgtcaccctaaccttcaaatcgataaacgggaatgcgttacctaataataatgagcaatgctgctaagagcaaatggttcctaacctcataaaaaaagagatagtcatatccgactatccggcaacacgcttggataagtaaggcgatgaaccgtacctttatctctaggcgcctatgatgtcttattatgtagatcatgtcttgcttgagagttccaaacctcgcccttctaaaaaagtacaaacccacgtctagggatatacgagcgccattcttcagatggatcgctcttcgatagttatttattgtagccgggataagcaggggttcctccttccgtcctagtttttttttagtacaagtagctaagggggctgggttgcgtctttcttgtgaaagaatacttgctgcgcacctgctgaaaggaagtcaaacggagattaccggttccggagggaccaaccattgtacttatagggtcaggtctatcttgcccttccaaatcacccatgtgtagctccaccgcacgagtcagaccttgtacgggcttttccacaggcttgaggcagactctttccttattgggcttcaatccgtttgtctttgcctcctctactgagtcagtgacagaagtgcagcagccaataatacgtatataagaagaggactgcttacgggatcaaactatcaatctcataagagaagaaatctctatgccccctttttcttggttttctcccatgcttttgttggtcaacaaccaaccacaactttctatagttcttcactactcctagaggcttgacggagtgaagctgtctggagggaatcattttgttgaaatcaattaatccaatatgcgacgaatctttttgtttgatgaaaatagtcttaattcaagttccaccattgatacatcttctgcttccaccattgatacatcttttgcgagtcaatgcactaacttttctagtggtcaagcgtccggtactcaggatactcatgctggtatttttgaggattgtccgggccttaatcctaacgatgagcgtgtagtagagctgcaatgtgagatacgcgagaagtgtgaggcattaacgcaagatcccgaaatgggcttgattttgggcgaagctttacatgcggaaagcgacaatgtcccttttttgcagtccattgctgatgatttaacccaaaacggagtatccggggaagcctttcaagaagctctgaatatagtgggacaggcggcggcctccccactggaccaatttgagattgtcccattgattcctatgcatatcggaaacttctatttctcattcacaaatccatctttgttcatgctgctaactctgagttttttcctacttctgattcattttgttactaaaaagggaggaggaaacttagtcccaaatgcttggcaatccttggtagagcttctttatgatttcgtgctgaacctggtaaaggaacaaataggtggtctttccgggaatgtgaaacaaatgtttttcccttgcatcttggtcacttttctttttttgttattttgtaatcttcagggtatgataccttatagcttcacagtgacaagtcattttctcattactttggctctctcattttcgatttttattggcattactatagtgggatttcaaagacatgggcttcattttttcagctttttattacccgcaggagtcccactgccgttagcaccttttttagtactccttgagctaatttcttattgttttcgcgcattaagcttaggaatacgtttatttgctaatatgatggccggtcatagtttagtaaagattttaagtgggttcgcttggactatgctatgtatgaatgatattttctattttataggggctcttggtcctttatttatagttcttgcattaaccggtctggaattaggtgtagctatattacaagcttatgtttttacgatcttaatctgtatttacttgaatgatgctataaatctccattaaagttcttctttcttttatttatatttataattgaacaaaagcgagggatggatgtctgagcggttgaaagagtcggtcttgaaaaccgaagtatttctaggaataccgggggttcgaatccctctccatccgcgaagtcataagttctctcttgccgcctgataagaacgaatcggatcgactcgactgatatgatagatggaatgggtaccttgtgttatgattttgttaggaactttgtctccctttcgttatcttctctttttttcttggtcggcaagggttagggcctttctcgctgggcgagcgcatccgattagtcctttcctaagccacttcccgttcagttgctgaaaaaaaaatggggataagctatgcgacgacagagaaatctgaatctactttttgccagttccacgaattctgcagataacgacgttctgccaggagtgccagttctggacatgtttcctaatatatcagtagacaccataattaaccaccccttctactgttcgggtacagtagctctcgcagaagaattggtggatcctattattatggagaggtggatagataggacgactagttgctcgatcaggaccttagctttattgcgagcctagaagtctctcttttttcggaacagcctttaagtaaaatccaacctaatatcattcagagtaaaaggactacggaaccaaagagaaccacacttgcttcgctaggaatgaagcagcacaccaatgggcaaagggtatgggcgacctatctgctgcgctagagaaagaaagaaagtgcttcgggctgctttgctgcgctagaggaaggagactgataaggagaggagtgatccaagctcaactcgatactccactcatctttctcgattctattgacataatttggtttcttctatattagtgaaatcattacatgacagtggatcttgcttggtacttgtccgaggggagatccatactcaactcatctttctcaattctactgacatgattacttggaattgattgtcgtgaactcaatctctcatataggcatagttgaatatcgcgaagcaaaaacccaaacttgaatatcgcgaagcaaaaggctacatcagacgatgtacaagtttttcaaaaatgatttgatcgattggtgtgtttcgatcttgttgattcactaggtaaatcacagcctcatccttctatattacctgttgatcgatcaaaaaaagcaccttacctcggatcaagaaaaaagaagaaaccgaatctcggaaaacgacaaatcacacagttgaacaaggtgggagtagctcgtgtgatctagtcgaaggtccataggaaactgataaggagaggggtcttccatctcactattctagattctaccgaattagttggaattgaattcgtccaagattaaatgccagttgaatgtcgactagtgttgaaggtccaagctgtactcgactcataattttgcttttctataccttactcgtgaaatcgatgatgattacatgacagtttaatgtcgccttattgcttgatccttatcttgtatccaaaccatactcaactcagaatctactgacgatcgaccaccaactcatgattacaaaaaccctctcttcgaaaacccaataatcataaaccaactcgtcgactttggttgatccttcacttggccaaaggtcctagccgtacttccctccactcataatcaccaactctatcaaatttttagaattgaaatgtttgactattacaaaagtacattttccatagagtgcaggaaccccatcccctcacccctcatcatctagcacacccttggggttcacatacggttttaaaaagcaaagcaactcttcatactcatggcgaagcacgcaacaagccgaaccctcaatcccagtgaggactactccgttgggggttacttcgcaaggacgccgcatgtgcagttcctcagtcttccttctcctccatatgaagatttatcccatacggtgctagcgaagcaagtcttccgagttcatactgcatctcgaacgaaggtcactcacagttccgaaggtcactacggtttccgagtcttattgttcttcttcttccacgtatgacagataccctcaaccctcaggcccacggggggttgctacgcccagggctactccgttggccctgaagggttacttcgttagggctacttggaggagttgaccaacccgaacatggtgccttgatcttcagctttccaataagaagatcattgatgcagcacactgagctaaattcttaaactatctttaccggtgtgctgcctcgcagagattctcaacctagtccgcgcatactctttccgtttctgtcttacagtctttcttgttcttcttttccctatagttagaagatgagcccctggggtgccctgcccttcttttacggctgatggacattcaatagatttatctgctgttgcctgatctacgaccccctcaatctgtcgaagcaaatgctgcacagagggagaagttgcctgaccgggctattcccttgttatctgttgtccaactggttgaatagtaatctgtgctggatccctctgaagctggtcattccttgtttccagttaatagtggagtcttacttacttgaattcctattactgttagctattagcacttgcttgttaggtgaggactctcttatctggttaaccttagtggtagcacactccaagtctagacaatcttcctcccaagaacctctcgataccagaatggctaccagggcgctactagaccaactcagatcagatcgtcggcataattaattctttttacttgcccagtagtggtctctgaagtttactactagtggtagtgcagaagacctctttacctacccggctactgacaggaaaggatgattttagattctttgcttgcccatacgccgatcctgttagctgactggtactacgaagatctatgccattcaaaggagagatatgaatacaccaactacagacaagaaagagactctaagtccaacccatgtcgtgggcagggagagacaggcaggcagctaacacagatatcagatattagacttggcaacagacgctttgatatgtgttacacagacgccctgtagacattgaatcggctcactccgacttcgattgctaaaatgttgacgtgaatagtgaatacgcttgctggttgtgatatgttccctactatactactattgaagaccttgacttttgatcttccttctaggagaattcatcaaaccttgcttatccttctgatgagcattcctctaactaagttagactgcctcttacgagcaggtaacctaccttctaaaccatgcccactatactttcttctaagccagcttttaactctttgttttcgtatcatctcattggacttatttcaaacaaactcgttacactcgcacctgattacacgggaacgaagaaaactacatggggagcacgcttacacctgcaagaactaagggtccagaccaagcacagacagatagaaccagacatcaaaaatcttcctttgcagcctatcagatatggaagttttcgacctgtctttcactggattgaaaagccttgtatgttgataggactatgtgggctgcattttgaagtttctttcatcgcaaactggccatggggtaaaccctctgagatagggggctgctcaatcccatgtatgttgacagggagagggagcgaactttcttatcatatcagagcaagccgaagacctcttccgggaaatcggttccacttccaatcttttttttgaagaaagaaaagtagcaagagaatggttcaagttcggatcgagtaacggtgattgaagggatgagatcggaagctcctgattcaaatagttaactgggctgtggttgtcgagtctgctttccctctctatcaaagcccttgcacctgccttctcagttcctcgtgcttagcgggactccttttctaattagaaggagacagattaggtcaagttgctccaggtatgaaatcaatcccatgttggtcgtaagagtggcaagccatgaggtaggtcttatggaaataaataagcatcttcctcaagcaactccttcatctgtggcggctgctcctccaagacaactgcccagcataactaaactcttatctttgacttgactctcttttgttctatgccccttaggtaggagtcagatctgttttgtagcttgtttcacccttctttgtagcttgccgtttggtgtgttcatccccgccctccctgaacggagctgttgctaaagcataactaatatcttagctgtttggaacgtatagctacccggttcttcctttctttagcggaggcgtaggtaacatatctatctatgagttgctgagaacgtctccaaagcataaggagttgttcttcaatttcaaccaagaagcacaggttcccgcaaccctgacgccagaagagttgcaagacgtggtctggtcgaacagattacgaccgctgacctttacagatcaattattttccatcttgaaagaacagccggaaggtatgaagctctagtccttctttctagccgtaaatcaagaactcgaaaggtttattactttgtttaatcgcttgactagcttcgaaagagcaatctcctcttctagtcttaccacaaatcaatgctttcaagaaagtgctcagttcctgacaacatggttcccggtcgcgcatccccatggaggtggatatttcacacattggggtcatcagccgtcgaacacagtcaagttagcaaagattcgtacgaaggaaaagaagaaagatagatggtttctaatgggaaggtagcagctgtcatcattatgatgattcaatccatattaatccctatttcagaactatgtattagttagacgacgtcaacggaacaagaactccttcctttacaggcaagcggggtagctgctgtctcgtttaggaacttgagttagtcgactaagaggtagaaagtggaaagaagcggcctaaaggattagcgacgacccctctcggcttaaagtaaaggaagcggcttgtcccatccaatgccctacttttaagtactcggtatgttcactcaatcagaagaagctttcggaagttcattggcctctgcggagcatgaaaaggcctgttttgaagctccggggacttattagcccgtcagccttacttcttaggaagaagagaaatgtgcttgacttcttcatcttataagatgacggcaacatcctagataagatctacgattcctgcttatgaatcatggcaaaccggtggtgaaaacagtattacagagtaggttggttaaattaaagcgggttactttgatcttatcgtctagccgggcatgagagcccaataaaaaaggaccgacgacgatccgagaaggacgaatcaataaatcgacttcctttagagcagacagactacgcgctaacagctttagaaactttgctatactaacaaagcaagcatagcaaagtcaaagtttgagttagaccgggtatgaggcaaagccaaaggcagaagtggtttatccaggtcggttgaatccccgaaataagcaccaattgctaccgtccaatcgctatcattatcatggttggagcatagatagcaaaggtatggttagaggtcaaatacacatatctaccaggtaggtgaaacgaattccatacccatatcgggtaatgggcctccaattacttcagcctaaaacgaagtctgaggtcgggtcaacaatctaataggttgccttcccccgttcgagagtcagaatcctagccaggtgaagatccactggatggcgggcggagtggctttagaaccgaaaaagtaagaaattccagagacggttgaccgagcggagacatcagaggaaggagcactaatggaagaggcatccattagctagggacacaagggctcttctctggtagcggagtctaagatcaagccagctagagaggcaggaagaggagaggcataactgattgattgttgttgactcttttttcccggttctaaagccaatcacagagaaatgggggcaaaagagcaagaagtagcacctacaatggaccgggtttaccgagtctcactaacagcatttagcctagcatcacagccaccagccgaaaaaaaaagtccctgacctcaaaccgaaggcatccgtggcaaagaaagcatctgagctggagattgtgttcggttcatgtctttgttttttattttgaaggttgggtgggattaatgagagttacgaggctttaaagagatatataggcacacaaacgttgatgcctttttaaaggctatgaaagttggaagctggtctttgttgactttttgtatcattcttttctagatgtgataatcataactctcatatatatcaactttaaggttttttataaggacatggttataatatgaaaagtttttggagagaaatccccattttcagtaaaacaaaagttttgcataaacgtatccgaatacacacatacattttacttctcggattagtttaccagttgaagactatagattgacaagatccatcatgaatcccatccgctatcgttattcgttacgattgtctccaccacatcaaccaaaatttgttgttattagcctttgttcgtcattgccaacgttctaatcatgtagtaactgcttgaatgatcaagaggtaagcagagaaatagaaaataaaaaatgagcagattaaagaggtggatgtggaaaagcaaagcagaaaagagaaatcgagaaaatcttttaactcgctagaagaatcatacatgtaattctactgagtataaaaaaatttggtggtttaaatgtcttgatagatgaaaaagtaagataattcaagaggagaaaaagaacaataatactataacaaataataacacagtacgtagttaattcaaataagtatgcattttaatgtgttttttcttcacacaactatattttctttatcttaaattaatccaatcgctagctctctaatgtcgttttgttcttctatctaaggggttttaattgtgaaattctgtctttgttttagagtttatctttgttgttacttatcagggtttgtagaaagaatcctattcaagttcctatagatgcatggcgtaaaaatctttgaggaggacctgcgtctagagaaggtaaagttttcaatctttatctttttatggcgtaagatggttcaccttctcaagatatgctttttttatatccaatcaaaacaattcaggttttgctttaaatctctgggaattcaagggagctgggatgatgataggtttatgttggttgataggtttgatttttactgtgataagtatttttgaattttatattgggtcattgcaccataaactggagatcgaaaaagaaaatatacgaagacaaacgtaaaagagaatgttttatcaaaaaaacttataaaaagcgaaatcaattctctcgacttttaagacatttagcagacctagaaatcaagatggtggatactttcggtatttggttttgttgttgttaactaatccattgttctctactctaaatttgtttagtacataagtcattttcatatcgtttttcttctgtacattgttcagtggtatgataagtcacttccgcatcaagatggcaaaacagatttttgataaggccatgcattttataaagctccaaagtagagatatatttgtttattggacacgtcccaaactagaagtttttccggtgtggagaagactaaaaatacactaattttggtgtggtttacatagactagaataaaaagatggtaaatgtcaatagttgtgccttcttctcatgtaagttaatcagctactttaacacttgtggttcttgaggatttaagtgctaaatactaagaagagcttatgagatcatgttctttaccatctcaatttctataacttttatgtaatttgagtgagctctgttttttttttctttcaatccgttgaaaagtttcgaaagagatgtgatgactattttgaaagtgtatagtagtcaactatagtgttattgttggaaagcatgtattatgttatgtgtatttctttaattaccttggtgcttaatttcttaatgtttactttaccatggattatactgattgaagaattttaaattgtttatccaaatttatcttaaccttcaattattccagaaaaagtagtcaaagaaacataggtcgaataattaaatgaaaagatattttgaaaattcttataacaaatataatgctggaaacaaagttgatagagttatttaaggataagttttaagggctgcaagctcttcatccatatttttctggttattatcgatgagttaaatttttatttgtgggagtattgaaaacgtatattcgaagggaaaaaatgattttgtgagctaaatttgttgccgtctacagcatcccagcgtactgtgtgagccgacatgtagaatttacaatttaaaactgttattttaataagtagttctcttacgttcaatatatttttaaatataaaaataaaataaatcatctaagagccaatttcacgaaagaaaaacaacaaaaagtttatcttaaaagagaattaatttcattctctattttagatgagtgttagagtatatatgtatatagcgtcatacatctagactaagttaaatattggtgttatttggtagggcttaagatatagtgtttaacatttagatgaagttaattatataggtttgggtttataaagtaggaactagggtttagtgttataaattcagatgaatttgaataactaatttgggtttataaggtagggttagggtttaaggaataactgatggaagcacatacaataatgtaaacttatatctttagttcatatctaactaaaaatatttgaacaatttgaaacctcattcgattatatttaaaattatttatgacttaaagttcattgtaattgtgtttatttggtatagtgtttaacatttagataaagttaaatataggttcggatttataaggtattaggtaggatttagtattattcatgtagacgaattgaaataactaatctgggtttataaggtacaggttagggtttaaggtttagaagtctcatgaatattaaaaaggggtgctaagtaatttgcaaggattaggcacttatggggcttggagttattcctcttctcctccgttgggaataagtttttttagtgaaagttgtccagaaaacgagagggaagaactcaactatttctcaatttgaagaagcttccggtggatcctttttttgttcttgagacctttgaagttaatcagtaggggtcctaggcgctagaatgtctagattgaaaaagtagcatatataagcttttttatttcaagagagtaaagtttaccctgttttagtgtaccaaaagataagagactgtgtttttgtgtgtaagaaatctcaagagacaagctaaagtagtcgaaactttgtgtaaaaccaattaagagagttacaagttctttataagattttttgatgaatttataagctcattgttgctgaattttttaaatttttttagttacttattattttgaagttagattttgatattgtcaaaagtatttatgggtccggcgcataggcagacacaaagaagattaaaggaggtcagctggtctttttagaattctacatttgcattgtaaccctttaaaattcatgatattatttatatatatttttttatttttactcttttaaaattacaaattcatatgtaaaccttctaagttttattgtatttttcttctactttgtggtttgacactatttctaacatgttttttactttttttgtttgattcacccataaacattgaaccatattttatctattttttaaatgaagttttttgagttttaaattttttggttacttattatttcgaagttatattttgatactttataaattatttatgggtccgccgcataggcagacccaaaaaagattaaagcaggtcaactggtctctctagaattttatattcgcattgtaacccattaaaatttatgatattatttatatttctattgtttttacctttaaaatcactaattcttatgtaaacatttaaagatttatcgtgtttttcttctactttgtgttttgatactatttctttgttttcaacttttttgtttgattcacccataaatattgaaccaaattttggtgtttttaaaagaaatgaagatttttttagttttttaattacttattattcaagttataatttgatcctataaaaagtattttggatccttgacttgaaatgtaaaattaacgggtacaatgtgatagttaatatcctaaacattatatgacacatgcctttgatacgggtaaatagatataaatataggtgttgttatatccatataatatatattttttaatttcgtaaatgtctctaacttatcactctaaattatgattgattcaagaagatactcattttaaatttttttggtcgaatttcaaaaattttggtatgcttgatctttaaaatttaaatttaattttaaaaaaacaaattttggtcgcgcaaggcgcgggtggctcacttagtctcatattattccttcacgaatctggacttattacattttcgtttataaaaggaacgttaatacccggttcattccagtttacagactcaatcatagttattctaaaccatactctaataaaaaccaaattagtcaaactgacccaaatcagaaacaaaacgaaccataaataaatcgaaatgcacatcactagcaacttttctataaaagtgaaagtgggtggacagacacttgggtagaaaacccaagagatgagtggcttccacgtcatcctttacagtgatcctcgcacgcatgtataacacttatatcagtcaaagtcattattttaatcaatggaccatttccaacttaactttaactttaatgatgccagctttgtgtcacaccacttactaataaacgtagaaatatatccaaaaatgaactaaaacactactctggaaatattaaatatagaaaaccaaagaattggaacagttcatcgggaagggttttgggaccctagagaatccatggctatcactctcactaatttcactgtaagtacactatttctttactttctctatggtttgttgatgatgaaaaatttatcaatctttgtctcagtttctctatatggatgcaaacctgaaacgtttaggcgacatatatccttccttgaacttcatgggtttataggagtttgcgtatgtatatagatacatgaatgctcaattttggattgttgttccttaagaatgattacagttttagggtttggagcaaatgtagttactcttcttctgattctgattctcaccataacgagaagaaatggtagatgtaacagaagggtaagagtaagcctaattttctactttggttttggtaaaaaaaaagaactgattcgtcctcatttgattttctttattagaaaagctacattgagaagtgtttgttgtatgtaacacctgcacttggagcttgtttgtcatgtgtggacttggtgttacttgtgagaacaaaccgtaggagagaagtcattctctgttttgtccccttgtctggtttcgtaatgtgggtaagcttcttgttaccaaacacgaacagaactctgtctttgtctttctcttttgtttctgctttgaaggttttttttaccttgtagattgccgtcatcctctcattgaagtttgcttgttgtgcgtgccacgttttcactagccagattctatgtttctggtggatctttagattcctaacagatgcccttcatcttaacatgattttcacattacaggtaattaagttgtctttatgaatctgtcacattctccatataagtagagttggttaaccgaatttggagcgtgtacaggagatttgcctcatcatgttggacattgcttttggtatctctattaatgtcctcaggataaagcaggcacatcccaaaatcatgtatatgctttaatatggttctcttatttaatatttttttccttttcatttcttgtttaattccttattctccttgtagtcctttggaagatccacttattgaagacgacgatgatcaaaagcgcattgtacgacgtctcttccttgtaactaactagtttaaagagtagttaaagaccaatagatttgttcattctttgaaggagaaaaatggaagctggtgggacttattcacttttgggtacattggttcaataatgaaacatggctcggtgaagcagctagaattggaaaatctacttacactaccacctgaaatggatccttttacatgttgtgagaatttattgagatgttggcaacttcaagagtgtaataattactcaactccatcactaatttggtcaatatatggtgtatatggatggccatattttcgtcttggactgttaaaggtacgttgcttatttgactttcttatataatctttgttaatattgctactacaaaacatgaattttgcaggtgttcaatgattgcattggatttgctggacccttacttctcaacagacttatcaagtatcttgaaaaaggttgagaatctttttaaagatttagtaaatatgattactaatggaatcattgacactgtttataaactaaacaggttcaggaagttctgttggctatacacttgctatctccttgggcttcatatctatctttaagtaaatatagtgcatagtcatcatatttctacatttttttgtcatctcaaatgtgttccaagtgtagcaatagttactaggcacttgtgatgtatgcttttttgtcttgtaggtcttttcttgatacacaatacacgtttcgtctttcaaagctgaaactcaagctacggtctagtataatgagtgtcatctacaggaaggtaaaacatgtgaaaagtgaaaacttttattgtgagtggtagtaattggttccataatttcttgaaagtgaactattatcacaagaattttgtatatatacagtatggttttggaaatttgtgctttgcttcagcgagtattcggttaaagatatcgatatctccttgccgttactacaaacggagacgcaccttttgagtatacgatatataacttcatacatagtatcaaacgttttggttcttttggtaaagagctgtttttgtttatgaaattatattgtatgcagtgtttgtgggtgaacacagcaaaccggtcaggattttctgaaggcgagattcaaacatttatgtcggtagatgctgaccgcattgttaacttgtgcaacagtttgcatgacttgtggaggtaagaacatttgcctgtaaacaatgaaagtgcttccaatattgagtaacaataaattggccactcttacaatttttcattcaaatatatgtctcagcctgcctttgcaaattgggatagctttgtatcttttgtatactcaagtcaagtttgcttttctttctggacttgcaatcaccatcttgctgataccaggtacccagtttacattatcgtaactacaatatagaatgcccatttttttcttttgaatatctggaagtgtaagcccaaaggccatacatctcctagaggcgagacccacaccattttagattcatctcctttgaaaaagaaatccctcccaacgtgcctcgaacctatcacctccacggagatttagtattgggccaatagctcgttggtgatgccagtttttctcattttccctttttttttggcagtgaataaatggatatcggtgctgattgcatctgcaacagagaaaatgatgaagcttaaagatgagaggtgtgagaaaacgtttagtaagtgttgatcataagagggatgttagtagtaatttctcacattgtaaaaagttttgttatctatcaggattagaaaaacaggagagcttttaacaaacatacgcacacttaaaatgtatggatgggataactggtttgctgattggttgaaggaaacaagagccaccgaagtgactcacttagcggttaggtcttcgtatccttccttttgctgttttgtccaagtactttgtattaacgtttaagtcttcgtttggcttttctagactcggaagtatttagatgcttggtgtgttttcttttgggcaacaacaccaactcttttttctctttgcacttttggtctctttgctctgatgggtcatcaacttgatgcagcaacggtactttttgaatctgctctataacattttctgattcaaatatgtaaaattttcttgacaatcctgtttttttttttccaggtgtttacttgtcttgctttgtttaatagcttaatctctccattaaactcgtttccatgggtcatcaacggtctcattgatgtaagattatctttcgatcatattaagaagcatttttatctaccattttagttatatatcatttttgttaccttgttgcaggcctttatatccaccaggcgtgtgagcaagttcttgtgttgtttggagcatagtagagatttttctatagattctggatttacatctgaagacttagctgtatgtgtggaagatgcatcttgtacttggtcaagtaacgtagaagaggattataacttgacaataaaacaagtaagcctaagagtgccaaagggatcttttgttgcagttatcggggaggtatacgaatcgtccccaccgttagagctgcatagttcgattaaattatgattaggtgtttcttaaactctttttgtttgcttaattttcaggttggttcaggtaaaacatcgttgttgaattcacttttaggcgaaatgcggtgtgttcatggatctatactattaaatggctctgtggcatatgtaccacaggtttgtaaactggttaaatactttctttttggtttccactatgagaagtcttacatgtacctcactcaccttcaaggtcccatggcttttgtctggaactgtacgtgaaaacattttattcgggaagccttttgactccaaaaggtttagtaagtttgcttcatcaactcttaaagttatgatctagtgtaactgatagacaaagctagtggtgactttgttaaactaggtatttcgagacattgagtgcttgtgcactagatgtggatatttcacttatggtcggaggagacatggcgtgtataggtgataaaggactaaacttatccggaggacagagagctcggtttgctttggccaggtttgctatatatctcctatgctctttcaccatccatagacttgagtgttgtgtttctgatgattttgtgtgtgctttatcaatagggctgtttatcatggttcagacatgtaccttcttgatgatgtactgagtgcagtggattcacaagtaggatgttggatattgcaaagagcacttctgggtcctctgttgaacaaaaagactcgtgttatgtgcactcacaacattcaggtctcaaatctctctacacgttaaatatttatctatctcaatttaattttttctcataccgtcaagctgtttctactatgacaggcgatatcttgtgcagatatgattgttgtgatggacaaaggaaaagtgaattggtcaggaagtgttactgatatgcccaaatccatttctccaacattttctttaaccaatgaatttgatatgtcatcaccaaatcacttgaccaaaagaaaagagactctatctatcaaggaagatggtgtagatgaaattagtgaagctgcggcggatatcgtcaaattagaggaacgaaaagagggtcgagttgaaatgatggtttataggtaaacaaaatttgcttaaccatgtcttttttttgttgcctatatgtataagtaagtgattgttatctgtttatgcaggaactatgctgtgttttctggttggttcattactattgtaatattggtttcagcggttttaatgcaagggtctcgtaatggaaatgatttgtggctatcatattgggttgacaagacaggaaaaggagtatcgcattactcaacctcgttttatttggtattaaactcgcgcataaaaccacgaaacgtaactcttatgtctctgtgtttttctagtttaataataactactaatcttgcagatggttctctgtatcttttgcatcattaactcaatattaaccttggtgagggcattctcatttgcatttggaggattaaaagcagcagtgcatgttcataatgcattaatcagtaagcttataaatgcacctacacagttctttgatcagacaccaagtggaagaatacttaataggttagacacaaggaaactctttgaatcatgtgtcttgttcttcatcttaacttctttttttggttttactctgttcaggttttcctctgatctatataccatcgacgactctctcccgtttattctcaacattcttctagcaaattttgttggcttgttagggattattgtagtattgtcttatgttcaggtttgtctgaaactcttctctctttttgctaagtattaactcttctgttttgttggagaagttacattaatgtataatatgtatacaggttctattcctgcttctgcttctgccattttggtacatatacagcaagcttcaggtacatatacaacttcttgtagccaatctgatttcatatttggtgtcccttagagaagaagaagagttcaaattttctactaactgaaaattgcttcaggtcttctacaggtctacttcaagggaactacgaaggttggacagtgtttcacgatcaccgatatatgcatcgttcacggagacacttgatgggtcatcaactatcagggcttttaagtctgaggtagttttggttctgcttctaaatgtcaggttttgcttctccattaatgacaaaactgtatgctaattccggtttgcatgacaggagcattttgtaggtagatttattgagcatttgacgctataccagcggacttcttactcagagataatcgcaagcttgtggctctccttgcgtcttcaggtacactaatacatctttgcttacattttgtagaacatttttcattcaccttttgagaattggtaacaatgtttagtttcatgtgtctgcaataaatatggaaatctcgaaaaatcgctgataagttgagtaaaatggtgcagttgttaggatcaatgattgtcttatttgtcgctgtaatggctgtcctcggctccggggggaactttccaatcagttttggtacacctggactggtaagaaactgcagttttcataaatatataggaaagtgaaaagcatactatttataatttggatcacaggtgggattagcgctctcatatgcagctccattggtttctctgttaggaagcttgttaacaagttttactgaaacagaaaaagaaatggtttctgttgaaagggttctccaggtaatgattctgattctttttttggtttgtcaaccgaaattaattgcagctcaaaagagccattcctgaggaatgttgtttacatatatgatatgatgtggttcggtacaaattcgtcgtgccaaattatccacttctacattcgcactacgagaaatcaaagataaagataatgattctgattcattaagtaatttttgtatgttagtgttactaattacatgaaccatgctctcctgtgttattagtacatggatgtgcctcaagaagaagtttcaggtcctcaatctctcagcgataagtggcctgttcacggattagttgagtttcacaatgtgacaatgagatacatctcaactctgcctccggccctcacccaaatttcttttacaatccaaggaggaatgcatgtacgtgtatcgccgagcactctacaacagacttgactttttctgtttttatcttttctcccaacatatacaatttatatgaagttatcgggaagagactatccgctagagagagcactctacaacagaattgactttttctgtctcatgattgttttgttttcatttatcaggtaggagtaattggaagaactggtgccgggaagtcctcgatcttgaatgcgcttttccggcttactcctgtttgtagtggagagatattggtggatggaaaaaacataagccatcttccgataagagaactccgttcttgcctcgctgttgttcctcagagcccttttctgtttcaaggatcactgaggtgagaacttaactccttcaattcactaaccaaaggtgttgcctgcagtttcataatgaaaaaaagttgtggttctcgtagggataaccttgatcctcttgggttgagtgaggattggagaatctgggagatcctagacaagtgtaaagttaaggcagcggtagaaagtgtaggagggttagattcatatgtaaaggaatctggttgttccttttctgttggacagagacagcttttgtgccttgctcgtgctttgctcaagtcatctaagatcctatgccttgatgaatgcaccgccaacatcgatgttcacacagcttccctactccacaacacgatatcgagtgaatgcaaaggcgtaaccgtcattaccattgctcaccgcatttctacggttgttgatttagacagcatcctaattcttgatcgtggaattcttgttgaacaaggaaaaccacaacatcttttgcaagatgactcctcaactttttcaagctttgtcagagcttctcagtgaaatgttgttagaatctgatcacttgtaacttctgatctctgctataattatcttgtcatggaaattaagaaaaactagtttcaactgtagtagctcatttatatgctcagttttccataataaatgagtcttcatggacttgcctaatccaaattcataaatatctatctaattcgatggtgattgagaactgagaagtaaacaatggtactcttattgtctgtttttcttccaagaagttagttcagaaggaattgattcttcattgcaacttaaaacagctttagccatgagtttcccaagctatgcatgatagagtaaagtaattggccaaaaatatgttaaatagagaagcaattatctctcaacaacacaagaacaaaatgaaattgagagattccgggagcttcagaaccagttcaaaattcaacaacatactagttttgtaacccgaaccagtttaaaagaagaacattttgagtcaagttcaaccatggttatttatttcatttttttttcaaggtaacaacattctactaataacaacattaagaaaattttaatttacatatacgttcagattacacttttactttatcaactattctatctgcatctttactttaactatcggcactagattataccattcagcaatcttcaaacgctttcctaacattggcgtgacattttaactaaggacaacaaaggtggagaatacattagtttgaagcaagcgtaaaagtttactaagaatcttcatcaaatacacatgacataagcttctctttctactttttgcctacaaattaacttgataatattaaatattttgttttgtttggtcatcgctgctactaaagaagagagattgcatgcctagacgatcaagctttgcggacaatagaacgtctctctcgctggtactcaacttcacctctctggtgcattatcaacaaagctctcctcacctgccattttaacatgcacattacctcaaaaatcccattcacattactgaaaattaaacaacaaagatgttagcttaggtaccattgaatcgttcattcccattctagccagatcctctatcagtcttctctctgataatcgagctccgatccccattcttctctttatctgtgtttccgcttgctgttttttcacaccaataccaaatttagttattacatctagagatacgatgattctttcttccccacaagcaactaaccttgatttcattggccatctcgcctgttatgtttatctgttgatttatccctgatcttgctgcatccattgtcgaggtatcaaaaagtttaaaagctttgtctacatcatctggtgtggcctcgtgtgacctgacatatttaacaatgtcaatggacggcacatcccatcaggtttcaggaatcaggaatctctatgttaataagattacttacagtctcatttttgcaagtgactcactcagtctgacaatagcttcgagttgtctcactgtgataggtatcggagcagcctctcctgtttcatgtgcacgtctcttcatatcctgtttagccgaaaattttatactgacaccaactttgttttttaaccatcttattgtcaaatctaatgtaaatgacaattaccattctgattgtgacatatttccgctgcaggttctcagcagcgtcttttgagagacggggatgacaccttgctcgacagtattgtatatacctaacataaaaagagcattatattttagagtcatgattttgtacagaaaactgcgagaacacattgttttctcgacgaatgaaaacacaccttttgagccaattatcttctttagaatctgtgttttcatccgaaaatttgtttgcagatgcatgaacccttataatatggctggctatttcctgtgaaaagattataaacattaatcatgtctacataataagcaagcaacgaagcaaactttccaataacagtgacctccatcattaatctctgttttcccttttaactacataaaatttctgaaagaattgttcctttccttgcttaccttgtcttgggaatacttcctgatgtccttgacaatgaagataagatcaaatctagaaagaattgttgtctgcagatcgatattgtcctgagcagtctgcaaatccaaagaaaaaaaaacacacccatctcttaagaatattgcaaacaagaatcgggaaaaccatgatattgccaaaggagagtaccagatttcaaaccttaaggtcatcatatcgaccagatggcgggttagcagcagcaagcaccgaggttctagaattaaggacagttgttatcccagcttttgcaatggagattgtctgctgctccattgcctcatgaatagcaaccctataaagaaaaaaaaaacattccatcaattctactcatagagaaaaattagattcgtcaacactatgattcagatttgaattacctatcttccggtctcatcttgtcaaattcatcaatacacacaacacctccatcagccaaaaccatagcaccaccttcaagatagaactctcgctgcaatgaacatatgtataaataactgagaatctgtcatagcaactacttttaaacaaatcatagaaaaacacttgaagataggacatacagtgctgctatctcgaatcaccgaagctgtgagcccagcagccgatgaaccctttccagatgtataaacagcaattggagccgtcttctccacaaacttaagaaactagagagaaaaaaaataagcaattaagctttaaacatgtaagctacaggtgttggaaataacacagacattttgtaaggattgtaatctaacacttgaacagaaggatgtaagacgaatatcaagcaaataagagagacgtaagaaaatataaaaagaataacacacttattataaaccattgatactgagaccacattacaaacctgtgattttgcagttgatgggtctcccaaaagcaaaacattaatatcacctcttagtttcactccatcgggcaggctctgaatcaaagatagaaatgtatataaatatatcaaaaacgtatacaaagtgcacagaaaataaaaactgctatcacagtttcctaccttcctggatcctccaaagagaagacacgcagctgctctcttcacatcctcatggccaaatatagaaggagcgatcttggtgcaaatgttcttgtatacatcttgactatcagcaaactttttgaattcttcctcctaaaagtaatattatggaagacaaaactgataaatggaattgtacaactaggcttccaagcaggcctaaatgtttcatagtaaactagtagcacagagaatatttccagaaaacaccatcacattcatttgggagttacacaaagaatttcatagagccaacagctacctaaggcatttggtttccagtaacaataattcagccatgttaacttcaatagttcattgtgaaaccatggatgacataggctatcaaatgagaaaacaaaaagaaccaaatgatgcgatactaacttcgtcaggagtgaagttggcagggccacgggaactggcctcatttgtgtcttccagtccaacaactcggatataaggctggcgaattgcaactgctcctttatgcctacatcagaaagtaggaaaagatgtccatcattgttgtggtgtaactctcccagaaaacaatctacactctcatttgacataaaactacaaagcttacgagttagatgatgacgaagcttggaaaatgctgtagatacccattactgtcagtctggttccaggtacaattgtttgtacaagatgccgatcaactgagagaagcatatttcttggaagctctccagtaggaacatccttcaaaactcagaagcatttaatatatacaagtgcaaaaaaagcgaaaacattacaatgtaaatctatacctccggattctcctgtagctttaaggtctgttgatcaacatactggctcctatcaggaaccaccatccaaggatcaagagggcaaggctcctctccaggctaaacaaattccaatttggtctaatcaacaccaaggataactacaaactcaaatcacaaacgaatcaaaagaactcacctgtggaatattatcacatgatcgaggaacaattgccccaccaagacccggacgacatggaacttcccttgtctttttacaattcttacataccaaaaacacataagtcgcctttgctttcactctcgaagctgcaatactaatcccagagattttcaccaactttgagatgtactgtgcctatcaagagtaaagagtacattatagacataccccaagtaatctcattgatactaaaaacaaaaaaacagacataccccaagtaatctcattgatactggatcctctcttgaagtgagcaaaatctgcacatctctagtcagaggttcctccattacccctccctcattagcctccctcattttcaatccagtcaacacttcaccagctgctttctcaaactacaattcaaagattgactcactcaatacaaagcttatatgaaccctaattttttttgaagtcataccacagggagataatcggcaggagcagatcggattaaggaggggagatcggaatcaaaggagaggagatcttcgaggtggacaacaagtcgcttagggttatcgaggagagcttctctgtaggggaaacaattctgttcgatctcgaagtttcgaatgaattccttaaatttggttaagacggcgtggggactgatggttgcggcgtctccggcctccgggaactgcggctggtcgctgtagtaaactgctccttcgtcccatcctgacatcgttgcttcgtctccgttacgaatttctctatctctttctctcttatcaaaaagttctaaacgaagagagagagtgggggcaagggctttatgtcgactatgagttttggcgggaacaatgtggcgggaaactgatgggccgaacccaagacctatggacgggtaaatggatttcgttggttattgggtctttctttctttttctttttagctaaggttacattttttatccattttttctaatttattataaaaaaccaaacagataaaaatataattatggactacatctaggaatcttaaatttatgaattgcacattttagaatttcatatttttaagctacttaatatcgttgtaagcattttcaattccatcgtaattttcttcaatgtcacttaaaatttaaggctatattaatatatatgtttaaaagaatagtttttagttttataacattaataatttgaaaattaagtaactataaaaaagaaaagaaaaatcaaccatatatatccttctcatttacgttaattacagaaatgtcattaacatgataaatgtttttgagaatattaggtaattggacacttttttgaaactcaattacgcaataaagcactttagaaagagtaaacactttttaaagtttttttactactacaccatcaacccaacctaagcaatccaaacttaccataatttacaaccattactttttctctcttttcattcatttttttctctactctttacaaaattaaacacacaaaacacttaaaatatcttaatgaaaaaaggaaatggtttgagacattatctctcttctctctcatcaaaaacaccaaaaagtagatctagatttttcttttttctttctcttcttagatcttaaaagttggaaattttcaagatttttattcagtttctcattctttaatcaacctcataaggttaaaattttcatttttaattgctaggtttcttcttctcttagtgtatccatcattgtcttggtcaaatttttgtctttttacaaatcttagatttggccaccaaatatttgtggaaattcctcaaagagagagagagagttgaattaaagaacccaaacatatattcttactataaatttgtaacttaaaggtagtttgatgctattttcattaaaacacatgagcaaataatgaaaaaatggaaaaaatacaaaacaaatcaaagaagagtgataggcgataatttgaaatgaccacatggtcagagtttggtggatgtgtgttgacggtcgataattcaaaatgattgtgttttgttaatactattcataaaaccagtgttacgttatgtaaaagatgttgataaaatgtgatgaaacaagttttgttggtcatatcaacaaaagtttatttatgaaaatgtttatatttatttatccacgattacatattaacaaaacataaatacgagtgtatatcgtaagattgtgtatgaacacatcgatctcaataatattttacgttttcaggttaagaagcgtgctttagattatcatggatcaaaagtggtggttatagattatgtacatataaaacttaggttttagggtttaggctttaaagtcaagggctagggtttaatgtctagggtttaagatttagtatctagtgtttacattttaggatttaggctttattgtttaggatttcgcgtttagtttagatgatttagggttttgggttgaagaatcaaagttgtctacaatgatttagggtttatggttacatgtttctcattggagattatatattccattgttgtccatatggattggataatatggattttctatctcaatttgtttatatttaggggatttatgtttaatatttatggacaacaacaagaagttttaaagtgaagatcttagaatttagggtttagggtttagggtatacgtgatatggtatatgtatattgttaagggtttagtctttatggtttaacaggtttagggtttaatatcaagggtttagagtttagggtttagggtttagggtttaggggtttagggtttaggatttaggatttaggatttaggatttaagatttagggtttagggtttcgggtataaatttaggggttagggtttaatgtttagagtttagtatctagtgtttagggttttagatttagtgttaaggaactatgattgtttacaatgattatagagtttattgtagatggtataaggtttagggttaattgaccatggtcatatacaattatttttgggtttagggttatatgcttcttgttagattatatatttccattttgatcatatgaattaaatcatatgaattttttatgttctcaattggtttatgtttaggggatttatgcttaatatttataagcaataataagaaggtttaaaatttagggtttatatggtaaatggtatatgatatatttctatggttaagggcttagtgtctatggtttaaagtttagggtttatggtttaggtgtttaaggtttagagtttagggtttagcgtttagggtttaaagtttagggtttagggtttagggtttagggataagaggtttaagcttaatatttatgggcaacattaagaaggtttgggatttagggtttatggtatatggtatatggtatagggtatacgtatatggttaagggcttagtgtttatgggttaaagtttagggtttagggtttagatatagaagttagggtttaatgtatagagtttaatatctaatgtttagggtttagaatttagtgttaaggaactatgattgtttataatgattttagagtttatggttatatggttctcattaaagattatatatttcattgttgtccaaatggattaaatcatatggattttttgttttctgaatctgtttatgttttgatgatacaataaataatagtatgaataaatatagtaatatggatttcatgaaggaaaaaatgttattattatatattttataaaaaatgatttttaatcaaatagagaatgtcttaaattaaataaaaattaaataacaaaaggaagagagagaagaaattgacaagaaagataagaaagtgatagatagagaaaatatgttttatttatttaaatttgacggtcaagattaaaagagattaactttacctttcaattcgatggacgagatgattccgtcaaaaccatttcttaaccatgctacttgatttaaggtgaagagaataaggggtaaactggtattgatttttttaaaatagtgaaaaaactccaaaaaagtgtctattctcttcaatgtgccctaaatgcactaaaaacttggaaaatgccccaatcatgaaagaagcccaattttttctgacgtaatatgtggcgacacagttcataaaccgctcgataacactgctcacatgcgaccgaaacactattcatcagatgatatagtaaaacatcatatgatttaagcatttatctatttgttttatatgctaaaaaatatgatatcgcgataagtttacttttaaacaaatcttttatcgacctagaattgaaaattaatatatttttatttatgtaaatatcagttcaatttaaagaattagtttatttcttacataattaatataatagcagttaaaacaacatgttatataaaataataacatgctaacatatttaatatctagataatatttgtatgaacgtgccatctcaatccacgttttcattcacgccacctctttttttgtcaactcaccaatactgattttaatatctttgtttcgatttgattttatgtttccattattattcttatagttttgtatcgtcagaaattaaataaaagagaaacaaaagaaagaaaaaaagaaaagagagaaaaggggtaaaagagtcaaaaagaggatgataaaaagaggataaacaaaaaagaggatgatagtgacatgtgcacagtgatcaagtggtcaacctaattaatgagtcgttcatgtatatctattgatattaccctaaaatttaaagatgtgattcaactaaataaaataagtttattacaaaaatataaactttttattaccttctaaattcacaaaaccacgtagtcaatttcaagtataaagcaaggttttgacaatttttagaataagacaattttttttacaaagatttaaccacttacatccaatactaaacgatgattttgttactattgtggtgattaaaatgctaaacacataaagacgctcataacctccatgtacgttaaagacatcaaatctaaatatttttccaaatttgatgttgtgttgtcaaaaccaagctggatgctcctcttaacatcaaagagatcatgtatgatatagacatactaaattaaacaagtatgattattatactatgaacttgaaatgtgaattgatttaagaatttacacccacaacctcatatctatcccataactagaatggtaatgtactaatcccgataatttagcaaacttgaattaaatcttcctagccatctcttctactctcaaatcactaataaggttcaaattaccctagaactactctctcatataagagatcaattgcagtatttaaggatcgaattcacaaagttcttttgttcaaacaataagttgaatgtcgagattaagctagaaggtgatgattgaaatagtaataaaacaaagtaagataacagcaggttgattgtgttgtaaaaaattaggaaaagaggtaggaacagagtattctcaagaaactattggttagtagatctaatgaaagctaggttgttatcgaaccattcttaaactcaaaccctaattatggaataaccggtggctttagtaccccgcgcattgaccccaggcaagaaagaagggcaagagaagaagaagagagaatggtgcgtgaaatgaaaggaagggccgagtatttataatccgcggaagctagagtagagcccaagtcttaaaacgtggagccgaatccattcgggcaaagccgacttggtgaccaagttttgtcctgagcaatgcacgccaactttagccaacttggtgagcaagttttgtcccaaagccaacttggtgaccaagttttgtcccactcctcatatccgaaccttgagcctataaatagaaccttacccccccccccttagttacaccttagaagctttcgcaccaaaactctgcccaaaccgagagggagagagagaaatcatccgaacccttaacccgagagagagagagagatcgtccgaaccttaaaacccgagagagagagagagagtctgagcaagagatcgtcgagccttaggatagtccgaaagagagatcccgagtagaaaccatcggtcgagttaggaagattcatcggtgattgtgagttccggtttttgttttgcatgtttgattttccttcttgcatgttctcgattctcccttctcttagttttgttgttgttatggttgagtttgttgaggttgttaacctaatagctaggatagttgagaccgaagcaccttgccctataggagtggttgtgttagaatagcaccattcactttagagggatggttgcattgtcaagacactactcgctagtattcgggagacatttagagagaactttatgaacatgtgcgttgaaaacgaaccgcatgtttcatagtgttgattggaagatcgtagtgtgtggagcttgaagagtatctaagttaactccataagcatgctacggtcaagtgggatgtatctgacctttccttgtgattctgttcgttcgtggggtgtgcttgacgagatgcaagtgacctcaaggggttcaaaggacctatagagactgggttagctacccaaggcccggtgtcgcttacacgatggtgtagccaaggtgatgttccagttatatgcatttgtggttataactagggtgttcacgatgtgttgaggaaggcagtgcattcgggtcctaattaaaactttaagaaacgttatcttcttgttgtgttgtgtgttgcttacttccttctttgtgtactctgattatttatgttatgcatgtgggattatgggtggggattaaactaatgtttccttagggaacccgagctcattgagtaatgctagattactcatgactttacttgttttgcatgaaaccttagaggggattagagggagtggtgaacactagggaacccggagtagtttttcaatgtccttttgtaaaacttaaaatatgtattttcgtatcgtgtacttttggacctcatgccttggccacaaaaacgatgtttatgttgtggtttttccttgtattttcgtaactctaaaataatgaaatcggtatttattttagagtatacgggtttcaaactgataagactttgtccgagtcgacacaacatttgggtgaagtgagggttggcaagcctaacactacaaaaaaatttgaatattcttacggaaaaattgcgaccattttttcgtcagaaaattgtaaccattttcttacaaaaatgtgacgtatttatttagtcataaaaacgttactatttcgttataatattatgtcttaattgaaagtaactaacgtttgtcactaattatattaaatttgttacgaattatatagtcataaatataaatacggatttgcgaccaaatatggtaactaaattatacaataattgtgactaaacttatgtcacgtatagttacgagagttttgtaactatcatgtcacaatttgtcactgttttagtgacttttgcgtttggtcatagattgtgacataattattaccaattttatcacaaaaataaaaacatgtgaactaaaagtcaaataaaaaaacagcttcaattttggaaagaaaaaaatctgataatacataaaattttgaaaagagtataaaaagttatataagaaaacagtttcaatttctttgttattttttctttttatttccaatgctttgttttaaaaaaaaaaatcccacgatctctcttttgcaatgcatgatctccaaattaacttcccagttttattaattattttcatcaatttcactttctttaaatcaccatatatatcccacaatcgatttatctcaattgttcttccattcatcccttctggaaaaaaaaactgtaaatacttttacggaatcgtcattcaacaccacgaattcatcttcattgttcgctaaatccaacattccacgactccgatcgtcttcttcctcctttcgtaaggtggtttcagtaacccaaatcaccacaaaatctaatattttaagagaaaatctttgttttgatttttttgatgtatttagttgcaggcactactgtttgcaacatgaagtcaaaatccccttctttttatatctccagaaatatgaacagttaatgctaattaaaaggtgtgattctgcttcttctaatgtggatctttttgtctaatttagatacattatataatatctaccctatttacatcctattctctgtcagctatccacctctacgtccacacttttgttttgttggagcggcatcaatcgttgattatatgtgatcttcatttaaggacaaaagttggaatatcatcatatgcttcgatcatgtcaaagaacccaaattaaagaagcacaatcaaatgatcaactgcttgaaggagacaccaaaagtttcgtcatcaaagaagaagataattgagtgacaaagaagaagtcaggtgatgagaagcaagagatgttcaaagcatcaaaaggccaactcacggtttcaataaaacattacgaaaagtaatggtttttgtggggggttgacattatttgaattcattttcaccctttttatttgttcaaagtttaggatctaatatgtagtatacaaaagcaaagaatcttgatcatcaatatatagacctattttacgttctatttttttaattacaaaactccaataagaaaggagtaaatgaataacgccatgtcaagttgttttaatttctggatatcactaaatttagttttatagataattttaatatgttaaaatggccatgtaacgggacagagcatgacattgtgtgactataatcgagtcactaattgtgttggatttgtgattgtattttggtcgcataatataacgggacaatgacttaaaaatatgagtagtaataatctgtgacaagtatgttacgattttatcgccactagttgtggcataattgtgacagtatcgtccgccacgaaatgtgtccatttttgcgactatattaacgtcgtcacaattagtaacgaattgttactattgttaatcgtcacatttgtttgtgacttttttgagaccttcatggatttgtgacgattttattgtgacattttaaatttcgtttcagtttcgtcataaaaaaattattgtgaccaaatatttttttattgtgacgttaatcatcgtatcaatattcagtttttattgtagtgtaagtggatcccaaatggggaaatgggtaaccttgagtgggtaaagggtcggaatgtgtttttgaacctcagctactctatgggaattcatttccattgtggcgtctccgagccgtgccgactggccgagttctagcgcggaccgggggcgttagaatgggtggtatcagagcatggttttagggcttttgggatccgttttttttttcaaacgttttatcgagtaaatagtcgcaaaaggcacttaggataatccgagtcgttcaccactattaggataggggggaaatattagatacctaatatcgttgttggattggatgcagatgtcaaggcaggtgtcggacgagaactagtcgagagatgtgatgtctagtcgtggaaactttgcgcagtatccggagtcggataactagataccgagtgagagtggtgagataaatggagattatattcacttggagccgtatggattacctgaatgggaaacccccgattccacgcccaggcactcgtcgcccgtatcgatgttcttcgatacatcaaatgagagttactttcgttctcgatcacataaccccgtacaatccccatcgatcgagcaaaaccatggaaaccctatccctgaaaccaagaaccaaggagccccgaaatgcagcaaaccttagacattattcagagtcaattgggtcatatgattgaaacacaacaacatcaacaacaaattcaagaaagccagcgagaggaatcaacatccgcaaagttcctgaagctcgtgatgatgatgagagacttaggaattcgcgtgtttaaaggagaacataacacggtcgtggcagacaagtggctacgagaccttgagatgaattttgagatttctcgatgtcctgacaatttcaagagacagatcgcggttaacttcttggacaaggatgcacgaatttggcgggagagcgtaactgccagaaaccaaggccaaatgatatcatgggaagcttttagaagagaattcgaaaagaagtactttccaccggaggcccgtgatcgattggagcagcaattcatgaagttagcacaagagacaaggagtgtctgagcatacgaacaagctttcacgcgactaaggaggtacttatataacggacaagatgatgaagcattgatggttcgcaggttcttgagaggactcaggctagagatatggggacgactacaagcggtcaaatatgacagtgtcaatgagctaaccgaacgggcagataatgtggaggagggtattgagatggagaagagtgtaaccaacaaggaaaatgattgatcgggagggaggaagactaataacgcgtaggccaaaaacaacgctcctaaattcacaccaaatcaggagagagacaatgatcgaggaagagcaagagcgaacttcacaaggtgtttcatgtgtctcaattaaaaagacatgtacccaaacccgatgctgtaatttcagaatcgatacccgaattgaagaccaacctcacatatccggaggggccactcgagatcggagaacggcgcattcgaaagtttaagaagcggttaattcctcaagttcaagtaatttgggaaaacaaaaccgacggttaattacattggagggtgaaaaaaagttccgggcaaaatatcctcaactgttcgacgttgaagaagaagatgacaatgaagccagtccatccaatactcagggaatttgggacaaattcctataaggagggcaaatgtagtaccccgcgcattgaccccgggcaagaaagaagggcaagagaagaagaagagagaatggtgcgcgaaatgaaaggaaggacgggtatttataatctgcggaagctagagtagagcccaattcttaaaacttggagccaaatccattcgggcaaagccgacttggtgaccaagttttgtcctgagccatgcacgccaacttcgagcccacgccttagccaacttggagccgaatccacctgagcgagccaacttggtgaccaagtttcgtcccaaagccgacttggtgaccaagtttcgtcccactcctcacatccgaactttgagcctataaatagaaccttacccccctttagttaaaccttagaagctttcgcaccaaaactctgcccaaaccgagagagagagagagattgtctgaacccttaacccgagagagagattgtccaaaccttaaaacccgagagagagagagagtccaagatagagatcgccaagccttaggatagtccaagagagagatcccgagtagaaaccatcggtcgagttaggaagattcatcagggattgtgagttccggtttttgttttgcatatttgattttcctttttgcatgttctcgattctcccttctcttagttttgttgttgttatggttgagtttgttgaggttgttaaccgaatagctaggatagttgagaccgaagcaccttgccctataggagtggttgtgttagaataacaccattcacttgagaaggatggttgcgttgtcaagacactactcgctagtattcaggagacatttagagagaactttatgagcatgtgtgttgaaaacgaaccgcatatttcatagtgttgattggaagatcatagtgtgtggagcgtggagagtatccaatttaactccataagcatgctacggtcaagtgggatgtatctgaccttgccatgtgagtccgttctttcgtggggagtgcttgacgagatgcaagtgacctcaaggggttcgaaggacccagagagactgggttaggtacccaaggcccggtgtcgcttacacgacagtgtagccaaggtgatgttccggttatatgcctttgtggttataactcgggtgttcacgatatgttgaggaaggcagtgcattcgggccctaattaaaactttaagaaacgttatctccttgttgtgttgtgtgttgcttacttccttctttgtgtactctgattatttatgttatgcatgtgggattatgggtggggattagactaacgtttccttgggaaacccgagctcattgagtaatgctagattactcatgactctacttgttttgcaggtaaccttagaggggattagagggaatggtgaacactagggaacccggagtagtttttcagtgtccttttgtaaaacttaaagtatgtaattttgtatcgtgtacttttgggcctcatgccttggccataaaaacgatgtttatgttgtggttttttcttgtattttcgtaactctaagataatgaaatcggtatttattttaaagtatacgggtttcaaactgataagaatttgtctgagttgacacaacaattgggtgaagtgagggttggcaagcctaaatggatcccaaatggggaaatgggtaaccttcagtgggctaagggtcggaatgtgtttaaatatgcatttttaatgagttcgtttgttcaccttagtagataggccgattcttattacacacctaaaaaccagactcatcaaataatagatccaactacatatacttatggtgggcatatctattgtctggattcaagatctagttagttactctagatctagcattaagcataattaaagatgaagaattctacagataacctagcaaagggggcaatctactaaactatatgaatccctaatgagaaaccctattcctaacaagcagattactcagacatattgattgaaggaaacaacataattgagtatgaaaacataaacacggcaaatagatttaagggaaagaagggatctcttcactgtattaggaactgaatcaatctctgaaaacactcgatgaatagcttatgtctctcagtaacagggtttgcaaaaagcttgataaaaaacttgataatgaaaacttaggtctaaacaatgtatatacaccctctaaaaacgtctagggactaataatgtaaatagaaaagttttctagggcaaatttcctcttctgtaaacttgaaagcgtctaggactttgctgggccgaaactggtgtcgatcgacactaggagtgtgtcgatcgacactcctcttgattcgtgaaaccaaagtcgtccttaccttactttttcttagcttttgctccaaaatgtctccttatctccattgttgtcccactgcatagaatacctgaaaagacactaaaaagactcgagaaataacataaagactcaagatcctatacctaaaacatagataaaatcagttaaaataaggatatatcaatcaccacaatctacatattcaatttataggaagttcaacatttgtagtaggatcctcactctcaccttctttatctttctcatttgacttatcttgattctctatttccatgttgtcctcagctggttcaaaagtacccaaatattcttgctccacatccgtctggtcattctgctttctctttttgggacgatccatttacttcacctgaaaagttcaatcaaacataaataatgaagaagccagtcattagccatttaaatatcatgaagtagaacaaggtcaattttctctctctacaaaggcaatttattagaggttaggtctcggccgaaagggcctttgcctgggaactcgaagtttgtccgactggtagccagttcccacctttccgtccacactggttctcacacttgttctcatccacatgtggaagtccgatctactattgggaatccctcttcgattgctgtttttgattctcttccggttgagacgctgggaacctcttcccctattcctagaattgttgaatttccctttagtgacgaatctttaaagactcctttacttgccgttatccccttcgacgacaagctctcttcgataaaacattatgtttctggcgaaagctcctccgatttggcaacaatgtctgagaactcctccactatcgtcagagagtctgatttggtccctaattctcgtttggtcgaggcaaagggctattccaccctatcacctaacgtgggggcgtcaatgcctatcgatacctctggcctgagccacgctgtaccttcgtccataccctctgagcctaccacaatatctgagaattcctctgctgcggtggatacaactctcctgaaaaatcctgctaacactggatcaagctttcccactaattttggtgccactgccactcctcttccggttaacaatcctcctcacacttccgctacccttccatgggcgaagaaatttaaggcctcgttgctaaaccttaagcaaatgtccagcccaacctttctcgatgatggtacccctgttgttgttgcgccaccctctgtattactgaagacagcagagatgtggaaaggccatcttatagcccaattttggggcctttgtccaccggattcaaatatcttcaatgatcttaatcttatacgatgaatttatggcgccatcacggttcgtattatctcggaaacagcttctttgatctacatctcgtctttggcaacgcgagaatgggtagtggatgtggggtccttgtacagtgtacccttggtatccagaaggccctctagaactcgaagaattacaaacggctcctacttgtacaattctcaagaacgaccttccgtagttgtgtttacttgatggaataattgttatagcaactggaattggcgagcccctgcatagagagcctttcttcacatttactcgacctcgtggtcgagtacctcagtctaggccactcgatgacaccactcgaccacgaggtcgagtaacaccttgccataccactcgatcatcacacgaactgtcactcgatcataacactcgatcacaacactcgaccccgatcgattagattcctggcccatcccttatcggtttactttgttttgtataaataagtcttcaagaattttgtcccaaaacatttaggttttgcttcacttttgatttctatttacctagtttattctatcattgcgccgtttgctctacacacttgtaattcgagattttccatgttattcggattctacatttgattttgtttagcacctagtttctctactctttatctctttatatatgcagtctacttgtttattggcaattatgtttttgagcatgtaatctgaatagtgacttagaatttttaaggataggatagaatggttggttgatctgtagtctataggatggttaagttttagaattgattgaaacccttctggattagttgtgtttaaggcttatttctctctgataaattggaattcgatccaaagcactcccgcacccagaaggtgttcgataaatgcttgatccactagatctagaggttttcgtctctatcccaagggattggccgtttagagcgtttattgactgtaataggttgaatcgtattgcctgcatagttagattctgttaatgggaattagtttgtgctagctttgcttgagggtttctatcacgatagtgaattaatatgttgttgaacttgttatgtagggatagcttgattgcgctttgttaaccatatgagcaggctaaggagaccactccatttgattacctcatccttaagaatttctcgtccatttgatttctttatttcattgctattgtttaaccatttttttttgtgttgcttagttttcacattttctacctattattaccaacttactcgaccacacccaatgtgtggcagtagattgtgcggtcgattatagttgttataatttctgtttgttattcgaacagttactggacctgtccctgctactggcttcaaccagtcgtggtcgagtgttttgtgtaattctgttagaatttctattttctacatgttcacttaggactgctaaaaactccaaaacctgctattgcttggcttgacttagtggcttccgatcacatctcatctgtttgcatcacacctaaagtggatttacacctaaaatactacaacgacacgatagtgtttaaggattaattgatcttaaaaacctattatcaattttgtgtcgttgccatttgggtgcttgtttgctatattggagatttcagaatatttaagatccagttctttttcgtttttattcaacgttactaactctgtgtttttttgtttgtctgatttgatccaggttttgcgaatcactagctttactcaacttcctctggaccgtgctaacgtatggttgttgctcagtgcatgcaaactcgatcgcaagggcatcagaacctcctttttaacgataacatgaaccgtattgctcttgaattaagggaacaattaaacacaaacgctatggctgatgaccagaacccagaattaccaaccaacattggtgcaggcgatgcaccatgcaaccacaatcaccgtaatggcatggttcatggcaacaagtttcacgacctcccatgaaggatccactcgaccacctagacgagtttgataggctctgcagcctaacaaagatcaatggaggcaatgaggatggcttcaagcttagattgtttccattttctctaggagacaaagctcatcagtgggaaaagtcgattcctcaaggctcaaatgattgcaagaaagccttctttgctaaattcttctcaaactcaaggactacaagactccggtatgagatttttggtttcacccagaaaaatgctgagactttctgtgaagcatgggagcgcttcaagggatatcagacgcaacgtcctcatcatggtttctctaaggcatcacacctaagtactctctacagaggcgttcttcctaagatcaggatgctccttgatacaacatccaacggaaatttcctgaacaaaggcgttcttcctaagatcaggatgctccttgagaacttagcttagtctgatggcaactataatgaagcaccgcatggatatgaaagctagaaatgacaagctggataagctaatcattgtgcaatagaagcaagtccattttctcagtgaagatgagacatttcaagtccaggatggggagactctccaataagaagaagttagttatgtgcaaaatcagggaggctacaacaaaggtttcaacaacttcaagtagaacaatcctaatatgttttacagaagtagcaatgttgcaaactcgcaggaacaagtctaccctccatagcagcgaatcaacccaaaccatttgttccatacaactagggtcaagggtttattcctaaggaactataacagggaagctatcaaccgcaacttccaccacctgggctcacaaagcagcaacaacaacatgcttccacaattcgagactcagacttgaagaacatgctctagcagattttccaaggacaagcaacatgagcaatggatttggccaaaaagatggccaaaatacacaacaaggttgattgcactttgaatgatctcaacatcaagattgaagcactaacgtctaaggtcagatacatggaaggccaaactgggtcgacctgtgctcccaaagttacaggacttccaaggaagtcaatacaaaccctaaagagtatgcgatcgttcacgccatcactatctgccaagatcgagagctacccattcgtcatgcctctaactcaatcactgaggaaaacgaagctcaggaagggcaggtttctaatcggattgaagtcttagttattgaacttgaccattcagctggatctcgccatcaaattctgtctaccttagaagagaaagtagccatcattgagagaatggtaaaacgatccaagccaactccattacctccacttgttcttccaaggaagttcaggaaagcttggatagagaagtatgaatctcttgtataggaacaactcaatgggatcaaagcagtgatgtcattaatataagttttcgagctgattcaataccctcacaaagacgtgagaaatttaatactagaaaggatcaagaggtatcacgattcagatgatgaatatgatgccactctgtttcaagctgctcgtgaaaaaattgttcaagaaaagttggaagattctggatccttcactctgccatgctctatcatgcatttagctttcaacaattatctatgtgatcttggagtttcagtcagcttaatgccactctctatggtaaagaagcttggattccttcagtatatgccttgtgacataaccttgatttgctgataggagttcaaggagaccttgacacactaagtcaaattcaaggaggagattaacctcgactcaactttgatgtcccttcagtttggtttgaagtagactatctaccagatgaggaagcagcctacttagaggaaaaatgaattgaggactcagttgcgcagctatcaatggaggatactgagaatgatgataagctcgatgaagaaaaggacttcttaagtcctttctgtcacactttccctgcctaataagtgtgagtactcaagctagagatttaaaacaaactcacttgggaggaaatcctatgtctatcaatgtatatatcttttattttttccttgttgtctttgatgcattttgttagtattttcaggagataagtataaagagttaagtgaagtgggttttacctctgagtgtgcaacagaacactcgaccacatcctgcaaggagcaagtgtatctgtgtaatcgagtataaagagggtttcactctcaagattttgaagtttcaacatgtcactttatcacccgaagccacatgctaatgaggaaatgtggtcgagtatatgtgatgattttggacctaatgtttttaaaaatcatcactatacttgaccaacagaagccatatggtgactagaggatgaatttgagtatgatgttgttttgatccaaaaattcaacattatactcgaccaacaaaatctatagagacttacagaggcttaatcaagtttacaggggattgcggaatgttctgagacttttctagtcaacagggaaccgtgtttaaagacaagaaaacagacgtggggttcaccaccaaaacttaatgttccccatgcctcccaccaaaagataagaaatccatctcttttgcttctccaccagatgtcagacgggccgccctgcgcccaaacgggccggcctgcgcccaaacgggccatccgcaatgtgcccgattctcttctgattcgcgacggacctgccggccgacgaccgcggtcttgaaaaacgagccctaacccgccccgcaaagcccagcggttagacaggccggcccgcaggcatatatgaaaaagggagtcaaatatatgccaagagaattgtcaccttgacatctatggaaagaaaattgtcaaaacatatagttagggccatcacaattctctgcgtttacatgtccaacttcatttgaaccacgagcattttgatctatacttaaaaggcagcatgtgttaaaacattgtacagaccacaatagttaactagatgtcaactccaagacaaattcacgtttgtgttactggtaaaaataaaatgcctcgaatactgatgataaaaatatttcaacttcatcacttggttggtataaaactagccacataccaggttcatgtgagttctctgtgatttcttctatatgatagtaggtttttacggtcaattaatcctaaaatactatcctgtcgttgtagtattttaggtgtcaatccaaaagggtgtgatgcagacagatgagatatgatcagaagttgttaaatcaagccaagcagaatttgattggttatctaacagtcctagtgttgatgcaaaaaacagtaaaaagtcacagaaatgactgatatactcgattgcagggtcaactgccagaagggaccctgttagaggtgtcagacgggccggcccgcgcccatcttgcccgccccgcagtgggctttctttttccggccgcggcggtcggcccgtttaggaccgcgggcaaaaatatcagtgtccaagcccggcctgcaaagccagcggatatacgggtctgcccgcgggcatttctattcacttgtttaaaagatgaatcattgaatacaataatgtctaaagaattttgattcaaaccttttattcatgtataacaatgtacaaactaatatggtacaatgccttttatgagttaccttttacaagttctgaattgtgaatcattgattaaaacatctagttacatacttacatttgacatctcctttaactcaaacgatgacatttatttaaactgaaaccaaacataagtacttaaacatagctacagttaactgaaacactttttcatttacttaaactgaaaccaaacataagtacttaagtatataagactgaaacaaaacataactacataaccaactaaacaaaaatactgaagtgaaactaaactaatgctaaaaagagaacctgcaactcatattcaaatctgaaattcaaactcaatacgtagaacaaatatcaatcctcaaaccaaacataagtacataactagctaaactcaattcaaaactgaaactaaactcaagctaagaatagaacgtgcaactcatatttaaatcaaaactgaatgcaaactcaattaaagacataagtgaaacagaaccaaactgaaacataaattttaaacataagtctgaataaaagaacttaagtcgaagagaaaaacctacaacatctcaaagacaaacagaaatctgaagtaaagtttcaaactctaacagaaccttaacttaaactcaaatccaaatatcccaaaaggaacaatgtcgtgtctcatcttgcaactcatttgtaaaccttaatctgaatttaaactcatattcaaatcttaaaatcaatgtagacttaatgaaagatacgtagaacaaaggatcataaaaacagaaccaaactaaaacaaaagtcaagactgaaacataattgtaacaagttaaactcaaatgtgaaacagaaaatgaacttaacaaaataaataaaaagtatatagagggatagtcatgggacttcctcccaagtgagcttgtttagagtctctagcttgactcctcacactaatcaagtggagaaaatgtgacagagggaacttgagaagtcctcctcttcactgatatcatcatcatactcagcatcctcccttgacagttgcacagctgagtactcaattcttctttcctcatagtaggctgcttcctcctttggaggatagtctttctcttctgaccaatctcaggtgatctcctttcttgaaatcgtgtcatggttgagctggggctgaacctccttttgcattcgacttagtttgtctctaagcttttcaacagtgtagctcagcttctgaatagttctgttctgcagatcagtcttccttttgagttccagccaatcaagtgaggagggtatactcgatcaagtagtcgagttcgatggcggagtttgaaccaaaatttgctccttcgctcttttgatctcaaggccttcacttggaaccgctctctggacctctaaggtttttccttctattggtggccttgtcggaaatttgttgatgtcaaactgtaacttgacatgcctcccaaggttgagatcaatcttaccatatctaacatctattattgctcccactgaggctaagaaaggtcttcctaagatcagtggatccttagactcttcatccatttcaagcacgacaaaatcagtgggtacctcaactccatctatcattactggcacgttctctagaatgctgaaaggtctccttgaagttctatcagcaaggatcaaggtgatgtcacatggattgtactgaacgaatcccagcttccttgccacagagagtggaattaaactgactgaggctcctagatcacatagacaattgttgaaagtcaattgcctaatggaacatggcagagtgaaagatccaggatcttccagcttctcttgaataatcctctcaccagcggcttgatgcataatgacatcgtcttcgtcatctgaatcctgatatatgttgagcctttccagtatcaggtttctcacatctttgtgagggtctgaaatcaacttgaggacttctactaagggcatcacaacttccatctcatcaagttgtttttctgctagagattcatatctgcttttccaagctttcctcaacgtccatggaagagcaagtgagggtgatggagctggcttgaatcgttttaccatcctctcgattatagcagtcttctcctccaagtcagactgagcctgatagaaagattgagatgaatagtcgatctcagcaacagagacttcaatctaagtggaagcctccccttcttgaattacactgtcctcagtgtttgatgtagagacatgttgagttggcagctttcgctcatgtctgatagtgattgcgtgtgcagtggcgtactccttagggtttttgattgcttttcctggaagctggcctgggttgtttgtaacaggtggtgaagtagtgatgccgtccagataccgtacccttgtgttcaatgattccaacctgctactcagttcattgaactgtctgtcaactttgttgtttaagtcagctagcttcttagcagattccattacccctgcggcttgaccttgcatgatctgttggagcatattcttgatgtctgattcctggggtgtagagggctgatgttgttgtggtgtgaaaccaggtggtggctgttgctgttgataccctccttggaactgttgcttaggaacgaacccttgactttggttgtaagtaacaaacggtttgggttggttctgctgcagctgctgttgagggtaaacttggtcctgaggattggcgacatttgtgcttctgtatgacagatttgggttgggtctgtaattgttgtaccctttgttgtagccgccttggttctgaacataactgatttcagcgccctgatcattctccccctcttggatttggaattcttcgtcttcagaggcgaagtgaacatgcttctgctgcactttgaggagtttgtcaattttgtcatggagagctttaatctctcggcggtgcttgtcatcagattcagtactggtgcggatgcttctgtcataatcctcgttgtaattgcaatccgactgagccaagttttcaactagctcccatccgtcttcgacatccttgttcaggaaattcccattggaggcggtgtcaaggagcatgcgtatcttaggcaggacgcctctgtaaagtgtgctgagaagagatgcttccttaaatccgtgatgggggcatttggtttgataacccttaaaccgctcccaagcttcacagaagctttcattttgcttctgagtgaatccggatatctcgttccagagtcttgcagtcctgaagttggagaagaattttgccaagaaggtccttttgcagtcatcccaggtcgtgattgatccctggggtagcgtcttttcccacatatgggctttatctccaagtgaaaatggaaacaagcgaagcttgaaaccatcttcactaactccattgattttagtaaggccacagagcctttcaaactcgtcaagatgatctagcggatcctccattggcaggccatgaaacttgttcccctgaaccattgcaatgagaccgcttttgatctcaaagttgttgttctgtattggagatggaacaattccatgacgctggttgtggttgtgagggaagtcaccagcaccaatgttggtaggttgctcttgctcatctacaacgtcagccattgtgtcggtttctgtctgttctcttagttggcgagcaatacggtagatgttatcgttgaataggagattctgatttccttgtgaccgtgtatgcatgcaacagatagcagccgggctataacagacgaatcagagatgcgtctggaaagcgggttgcaaggtacctgaaacacaaagacagaaaaggcacaatgttagtaacttgtgtaacaaaaacgaacctgatcttaatgtttctaatgatctcaaatatagcaaacaaacatcaaactggcaacggcgcgaaattgatagtaggatttttgtcaattaatccctaaaacattatcttgtcgttgtagtattttaggatgtcaatctaatccggtgtgatgcaaaaagatgagatatgatcagaaagctctaagtcaagccaagcagatggttggttggttctaacagtcctagtatgcaataacagaaatgaaatgaaactaaaagcaggaatggcaatagcaggcaagtgaatgacaaagcagaaatgataacaggcaatcaaatggataaacgattcataaggatggggtaatcgaatagtatggtctaattaatctattcaggcggttgacaaaacttcacagaagctatccctagacaacaagttcaacaacagattaattcactcccgtgatagaaatcctcaagcaaagctaaacactgacctaaatccctttagcgatctctaactaagcaggcattatcgaatcaacatgttaaagtcaataccctctctaaagccaatcccttggggtagagtcagatatctctggaattaataggatccaacgcccattaaacgtcttctaagcgctggacgtctggactcatactccacattagccagtgaaataagcaataagcgcaactaatccagaagggattctagttttctaaactcaaccacctaaaacgaccaagtaaaccacaactattctatcccatcctcagaaatacagttcactactcagacataatcaaagacaataacaaagcaacaattgaaaacatgataacagaaatgacgaaagacttaaacgaaaactgaatatcaaatacttgaaaacgaaactacaaagtcgcagaaaaaacactgcagctatcaaagttgcgaaaatgtaaaagcgagataaaaacggataatagcggataatagccgacgccctagggaaaaccctaagaggcagtttatataagcgagaaataaaacaaataaggaaactaaatatatagcgaatcttcacgtcatgatcctgcgaccgaatatgtcattggcatctaacgggcagaaatgagcttcctagtgatcgaatatgtcattgatcaaactgggcttcaggggctccgtcttgcgaaatgtagtgaagtcgagattgaatggtccaacgaccttgtgatcgagtgcgatcgagtggatgtcatgagggtgtgatcgagtggtttcttcggcttctcttctcttctttgttctcagcttgtctggttgagtgcagaatgagcagataggcttcctggtgatagagtggtgatcgagtggttctgatggggtgattcctccggcttcgcgattgagtgaaactgagctgcttgcttctccggggttgcgatagagtgatttgccctggcagggctccgaggctgcggatagagtacttttttctgaaggcgtcattgggcattctgacttcatgttctgtataattaacttaattaatactaagtataattaactaacctcctaattaacttaattaatatgcggataaactcggacgatcttatccatacggaatagataggcatgaacgaacttatccatattcgttcctatctacttctcgtagaaccgtaaccatgacgggttcacccaacgcatcaacacattaatctcagtcacccaagtctccgttccactcgactcacccatccggttccccgaccacttgctcatgaatatctccaaaactgccagaccgttggtccgacaaacaatactcttcccataaggactttttccgaccgttccgattgtacggcttgctaaatcatcgagtaaaattcctcggcctagtcctagtcctggccaggggtattacaatatctatcccgacctttgaaatcatatagccgcttatagaatactttctcctcaggctatgacaaagaaaaaggtgcaggtggaagatagattattttacctcttttaataggatgtaaatcttttctaacgcaaaaaagttgtaaatctttgcgagtctttaacccattctttggtttcccacagtgcaacaatgcttgcacacacaattctcttaacatgtatgacattgaaactgtgtttaactgccagatcttgaaaaataaaataaaagtaaatatagataaatgctaaactttgtaagcatcccagttacaacaatactattcaaagagatcactatagaaacattcaataaggcaacttgaaaaagatagaccttttcttcaaccttgatggtcttcctcgtcgttttcttcctcttcctcttcctcttcatctcattcactttcttcactttcatcacatgaggctgtctcaattacagtttcagtcctagctctcttcttctctgtctctttcctattcccaaaatcaattttgaattttttttaagaggacatatatattatgactagttaatattttaaccttactctcatgttcaaattttcaatcaaaccatgttttcttcccctgataactgtgatttggtggtagaccattgcgatgacacatatcaacatgctttctacctttacataatcacatattgtcaatttttcctacgtaaaggacaacccatcttaccttttactttgcatactacaagatttccatatagagggaaatcattgatagtccataggagcattgctttagggttgaaagtactcttactgtaggcatcatatgttaactttccgttgctccacaactggataagatcctctttcaggggttataactaaatatcaatgatattaccaggttaatgcagccagaaatcaacaaggtaagcattagcagcattatgttttcttttttcatacacaggtctcgagtaatattataattaactagttatatgttcttttttaatgcagcaaaagtagggtatttggcatttacttgcttccgagtcacataatctacagggtgaaaaaaatttccgtcttattactaaaatggcaccttaggtcattggcttgttgctcagacctaaacattctctttagacgtggtataattggaaagtaccttagaatttttctgtgaaacatttttctttatttgaccagtgtgcatgtttatcttccatcttctatctagaagctatgcatttaggacatgcgtcaagcttcttcagccttttcatgaatagataatgattattaataaaagcatgaatatcttttaataacctatatcaaaagatttcaggaacttcttcacatcatacattgatgtatatagaacattatcttctagtaaaatgtttggtaaagtctcctgaagatcattgaagcttttgtctgaccacccattttgtgtctttattttatacagtgacacaattgtagaaagcttgctatggtttgcacaacttgggtataaaggagtttcacattgataagtctgcattttacttgtcttaggcatccatttcccatcactttagcatcctatcaccactgtttcataccatttcgcaacatttgtcatcacattgcatgttaaggatagttttgcatgcatattacatatttgtgttgttttcaggtgaattggagctgatggtgaactaattggaagaagtggacctgaaccgatcaacatactcgaccatgagctcgagtagtgtcatcatggactttttgaagtactcgccacaacctctacagctgatcactcgaccacgacactctatccaccactcgacccttaggtcgagtagaagactcaccacttctcacaaccactcgaccccgaggtcgagtagcagccatcaccatttctcaccatcactcgatccagtggccgagcatcaccatcatcaatcactcgatcgcacactcgacctcgtggtcgagtcccctcatcatcactcactcgatccatcactctgccaccaagttgagttccaccatcatccaccactcgacatcatactcgactgccagcttcagagtcttcttgattccgcaatcaacaagacactcgagcataaggaagagatgaagactttggctcgtcactcgacccactacttgatcacctgggtcgagtaccattcttaatctgttccaatactgtgtcgttttgagtattagggtttcagaatattttgctataagtagcatgtactttattttttcaaaaacaagtttttattccgcacacagtttgtgtgttatttgcttttgtaatccgaatttcttttaatctattcagtattcgctttttgtttattttactaagttgttcatcctgttatcatcatgttattactcttttgctatgatgttttcattcatgtcatcatttatggtctctataatgatgtctgagtagtgactaggtttctgaggatgggttatagtagtttagaatcctcggtctgttaggtggttgagtttgatttacagatcccttctggattagttgttcttaatgcatattgctttctgatcaactggaatttgagcccagatatttctgcacccaaaaggtattcgacgaaatgtttgaaccactaattccagagatttgtggctctgtaccaaggtattggttacagggagcgttttggctttaacttgatgattcctaatgcctcttaggttagctctcgtcaatggtgattgagtctcagactagtttaacttgagggagtctgttgcggtggcacttagatttggttatcgaacttattatctagggatagtttattgatcatctcaatcacttctagattgaggaaactaactactcgattaccccatcctcgggaatttcttatccaattgatttatttgcttacactgctattgttctcttgttcttattactcgttgcttagtttttgcatttcatacttgttatcactcatatacccgatcacacccagttgtctagtaagagattgtgcagtcgagtatctttgttacagtttctgcttgttactcgacctgtcactcaaccacacctagtgcttggcaacaagcagtgttggtcgagtgttttctttatcctactagattttctgtttcctgcatgttcacttaggagtactagaaactcaaaaacctgttattgcttggcttgactctgtgacctctgatggcatcttgattgttagcatcacacccatttggattgacaaccttcagtagtacaacaacatgatagtgttttaggattaattgatgttaaaaacctattatcaaacatcatctagctttgcaaggaactcatcttccatcttgtcctctacctcaccatcaaggtttatgagtttgtaatccattttcttgctattttgttacgaatttgagtttgattttttctgtagagttgtttatcttgcttagatctacatcatactcagtttacaatgatttctgggttttgtcctttttctaaattttgtatgatgatgttcttgagtgttcttgagtagtgttctctagagttcttgaatatgggttaggtttaggtggactcctctgtttatttagttagctaaggttataattgcatgattcccttcacgattaggagttcttagtgttatttcctttctgatcaactggagattgattttagacttttcacgcccaaaaggtgtttgatgaaatgtgtgaaccaacttattccagagatttgcatactctaccccaagagattggatgtttagaatgcttattgactttaatagattgttgcttaatgtttgctttgttatgtttcatcaatgagaattgtgattaggaagtggtaaagttatgaggatcattgtcacgagagtggattgatctgggttaatctattgtctagggatagcttgattgagtttgttagttagctgaaccaattactccattctaaagagctacgttttgattagattgatttaaacttcgtgctattactctttgcttgttgtgtttagttatcttgctcgacttatttacttgaccaaatttagtattatgctcggccgagtgccttactttctgtttaatatagtttcattttgaatctgatttgcatgataacatgttgcttggtttagtggaaataaaccaaacctattcacacttggcttgacttagtattctctcattgcatcatgattgttagcgagacactcatttggattgacaccttaaatactacaatgacatgatagtataaaggaattgatcttttggaaacacagtaaaaaccagactatcaatttgacgttattgccatatgggtgtttacttgttacatttaggatttctgagttattaagatcaagttctatttcatctttctcgaaactcacttctcttttcatttgcttgtttttatcttgtaagtactgtcatactccactagcacttcgagtgtaaggatcgaggaacttcacccaatgtatgcaaactccattcttaaggttttgacaatcttctgcggtatagagacaacatcgacatgattcagcgtaactgagagaacaacaagccacatcagatctggttgtgatggcgactgaagacaatactaatgagttgccaggcaacattggtgtaggagatgcacccataaaccatcatcgaagagctgatattgtcccacctcctattcagattaacgactttgaaattaagagtggtctgatgtccatgatacaaggtaacaagtttcatggtctgcctatagaggacccataagatcatcttgaaagctttgatatagtgtgtagtttaatcaagatcaatgggttcgtgaagacagcttcaagctcaagctattccctttctcacttggagataaagctcatgtttgggaaaagactttgcatgttgaatccatatgcacatgggatgactgttagaaagttttcctagctaagttcttctctaactcaaaaacagttagattgaggaatgagatctcgggtttcacacagaagcaatctgaatccttctctgaagtatgggaacactacaagggatacactactcaatgccctcatacttcacctattcgaaacatgacggctatgcttcaacaaaacctaaaaagtcaaactactagttctttggtcttggaaaaacatattattgagataaacactgattaggttcaaattaccctaagaactattatctcaaatatttaaggatcgaatttcacaaagtttttttgttcacacaatgaattaaatatcgagattaagctagtagggaatgattgaaaataaaggagaacaaagtaaaaagacagcagattaattggttgtaaacgattaaataaagagttaggaacatggtattctcaggaaactattggttagtagatctaatgaaagctaggttgttatcgaaccattcttaaactcaaactctaattatgcaataaccggtggtgttccgccaaactccctatgcttatagctaagaataaccggagaagccgagagatctttaacctaaacatgcattctaaacgagttcaattgttcaccttactagatagaccgattcttattacacacctataaaccaggttaatcaaataataaatccaattacagatacctatggtgggcatatctattgtctggcttcaagatctagttaatttctgtagatctaccattaagtataatcaaagatgaagaattctacagataacctagaaaaggaggcaatatactaaaccatatgaatccccaatgagaaaccctattcctaacaagcaaactactcagacatattgaatgaaacaaacaacataattgagtaacaaagtataaacacagcaaataagataagagtaagaaaggatctcttcactctattgaaaactgaataaatctctgaaatattgaaaactgaatgaatctctgaaaacaaatgatgaatagcttatgtctctgaagatagggattgcaaagaacttgataaaaggaacttaggtctaaacaacgacctctaaaactatatataaatcctataaaacgtccatggactaataatgcaaatagggaagtcttttggggcaaatttccacttttgtaaacttgaaagcataatggactttgctaggccgaaactggtgtcgatcgtcaccagaagtgtgttgatcgacactctgcctgaatctggaatccgaaatcgtcattagcttccttttccttaacttttgctccaaaatgtctcctcatctccattgtcgtcccactgcatagaatacctgaaaagacactaaaagactcgagaaataacataaacactaaaaatcctatacctaaaacgtagctaaaatcagtaaaaatagagttatatcaactcccccagacttaggttttgtttgccctcaagcaaaacacaaaagccgaacccgtggaagaggttttgaaaacaaaggaacttcaacattctctagcctattgccatgatcatccaaactaaatccacatgcctaacaagtctaatcaaatcttaaccaacatgtatttctctccaagcttacagaactttctagattccatacctaagttccacaactatatccaccaggctttcatcgatgggtctcatcaaacaagctaacattcaagatccttctagactcattcctgaactataccatgataaatcgaccattctcgcatactggatcaacaccttcgacagttttccaacctttgtaattgatcattccaaataatgtataataatggggtcataggaaacattcctaccccgatacactatccgaaaatcatgtcaatctctcattttctttttatttttataaggggagaggaacacattctttctatcacattggtctcaatatcaagtatgaacaaggagtcaagatctatcaatactaaccgtttgaagaggtaaaaggaagagcagttagattagctccggccttagtggttgtgttggaaactaggatatcctcaagtctgttggtatgccatctagattttccaatagtcgaattgagtcgaacctgcagcactcatcaatcaggcaatagttcataactaaactaaacaaaacgttttttttttttaagagtaagaaaatgagtcaataaactcaaaaacaaaaatgataagaataaaaaataaaagcaatattggtaagaacctcccccacacttaaacgacactgtccccagtggcattcaaatccgaagaaggcggaaaaaataaatcaaaaataaaagaaaagaaaagaaaagaaaagaataatcaaaccagtgggttacctcccactaagtgcttgttttgagtcaatagcttgacttggcagagttcaggatgtgggtagattggtggaggattgttgttgcctccgccccctccatggcggtgtgtaaactgaaccggtctaggcagctgcatgtgtcgatcgacactcaatggtgtgtcgatcgacactcttctcgtcacctgcaagaacaacaagagaaacaagcattcgagaaactctaggcttgttaacatgtgaagcagacttcatagaatctaaggaattaattgaaggtaaagcaggagaagagatagaagagaacttatcacagagggcctcaagtggtgtgggctgaagaggatgtgcagaatcctctgtctgtgaatctcgagggtgtcgatcgacaggagggatggtgtcgatcgacactgatgctctgcaactctcattggcgagctgagctgatgggagtgttatgtgtggctctgttttgggattctgagcagtcagaggaggtgtgtctgtgctctaaacgtagttagtaagtgcctcccccaaacttaaacgacattgtccccagtgcattcaaatctgaagtaagcaaggaaatataagaaaaatgtaaataaaaagaaaagaaaacaaaactcatactagtgggttgtctcccactaagcgcttctttatagtcaatagcttgactttgtcgaagtgcagatgtcaagtggattagatagtggcagtgattccagcttgaaacgtagctattgtagataattctgcttaaacaagtgatgggggtcgatctacactagtggtggtgtcgatcgacaccaccactagcagtctgaaatctgttcctagacaataacagtcttccttatgtctccctgattttgtggagccttgcagtgctcctcctaaatctggtgcatatactgttgaggcattggacaaggaattttatgcgtgtagacttgttcaacaacaggtggaaagtcaaggctgattggtgcagtctgcgtccaatgtcgatctttatacttttttgaggcatccgttagttaactggacgcatactgcaccaatcagccttgactttccaaaagtaaaagggggacttgcatccgttaggtaagcaatgcaatcgaatttatacttttttgggactctacgaaccattctccgtgggtcccacccgctacgtagggaaactccatctagtcgtaacgaggcttgatacatgataaaaatgcgaaaacaacgtctaaacaaataatttaattcccgtaatatcgtatggatcacaaaaaagcccaaaaaattatataaaggtctaaatttggagtaaaaaaatttaaaaatatacttaccattgccttgcttctttcgtcggagggctctcattgtgatttccgaaaagctatcacgtaccaaattttccctcacggtttaaaagttatagagtcaaaacgttttaactaaaaaaaaaacaaaaagggatgaaaaaaacacgaagacttttcaggacccacccgctacgtacggatactccatctagtttaaatgaggcttgatacattaaaaaaatgcgaaaacaacgtccgaacaaataattttgtttcttaatatagcacggatcacgaaaagacccggaaaagtatctaaaggtcaaaatttggagtaaaaaaaagaagggtacttaccattgtcttgcttctttcgtcggagggctctcattgtgctttccgaaaagctatcacatgccaactttggcctcacggtttaaaagttatgagtcaaaaagttttaacataaaaaaaaagggatgcaacacgaggacttctcaggaggtcacccatcctagtattactctcgccaaagcacgtttaactgtggagttctgatgggatccgttgcattcgttttggtatgatcacatccgttagtacatgctatgcaatcgtatttatacttttttggccactctaggaaccattcgctgtgggtcccacccgctacgtagcgatactccatctagttttaacgaggcttggtacatgataaaaatgcgaaaaaacgtccgaacaaataattttgtttcgtaatataacacagatcacgaaaagacccgaaatagtacctaaaggtcaaaatttggagtcaaaaacaaacaatggtacttatcattgccttgcttctttcgtcggatggctctcattgtgatttccgaaaagttatgacatgccaagtttggccttatggtttaaaagttataaagtcaaaaagttttaactaaaaaaaaaacaaaagggatgcaacacgaaaacttctcatgaggtcaccctctaatactactctcgtccaagcacgcttaactgcagtgttctgatgggatccggtgcattagtgctggtatgatcgcatctgttagtacatgcaatgcaatcgtatttatacttttttggccactctaggaagcattctccatgggtctcacccgctatatacggatactccatctagtttaacgaggcttgatacgtaataaaaatgcgaaaacaacgtccgaacaaataattttgtttcataatgtatggatcacgaaaaagctcgaaaacgtacctaaaggtcaaaatttggagtcgaaaaaaaaatggtacttaccattgctttgcttcttcggagggctctcattgtgattttcgaaaaggtatcatataccaatttttacctcacggtttaaaagttataaagtcaaaaggttttaactaaaaaaaaacaaaagggatgcaacacgagaacttctcggaaggtcacccttctagtactactctcgaccaatcacgcttaactacagtgttctgataggatccggtgcatcttgatgaaatttagttatttttatcatcacaaaaatattagaaaaagtataataatgttacatttacaaaatttcatcattaattcgtattattaataaaaatggattttatagttaatttttagtacaaaatgataattaaatctttgtttggtatctttttttactatttaaatatttttttgttattttataccttattttgcattgagctttgaaattttaacaaatactaaaatactttaaaaacatttagtaaacaaatagagttagttagcatttaatagtttttaaacaaataaaataacctaatacaatatttctaataataaaacatatgttacatttaaaaaaaaacgcggttttgttaaacaaatgtttttgtttgctattgtaatatatacttaaaaaatattgaaaaatgataatgtataatatatgttgtgtaggcagaattttaaaagtttatttaaatattataatcattttccctgtatattccataaatatcagatttttcatcatttaattaatttcttagttttggaaaaatttagattaatatcttaatgaattatttctattttcaattcaagattaaaacaaaatcaacggtcaagatttttgtctttttagaatatcaataaactgttgagattataaagtgaaaccgggtcaaaattcgcatcaaaaagatgtgtgtgttttgaaactgttttttccatgaaataagtttttttaacccacttgtatttttgtgattacttcaaactttttgcccatctcactaaacaaactgcacaaataatagtatatatatatatatatatatatatatatatgctttatacaaatctctgcttttctaatccaaatcaattcaagatgcataaatcgtttgatcaaatttaaatgataagacgctatatatgataatgaaaaaatgataaaaccaaactgtttatcatcgtatcaaaaaccaatgaatgagacattcaaaactttaataaccaaacctacctacatgtataaggctcaccttttgatcctcatcgggtttctgcaaattgacaaaacaaagactaaaatccaaaatcaaaaattttaaaaagaattactcatattctacaaatatagagaggtggaaaatcttaacatattactttgcataaaagattctactatattatttgggaagtacattttaaatgtaacctcaatttttgtaattaattacatgaaatgccattagaaaaaattaatcaaaaacaaaatcttttaatgacgtcattaaggttaccaaaatcatttaacgacaatattcatttcttaattatatggcttatcagatctaaagacgggtcatcaaagatttcctaaactgaagcaaaatataccgaatattcaaatatctatctgttaccaaattagaaacaaataagttaataagtcaataactatttggagggacgggtttttgaatcaacattaataaaaaagtaaaatataattaatccaccgtttcaatacgggtaaaatctttaatttattattttgtaagaccactaatattaaacatatcaaatcaatctaatttataaaaggttatataaaacaaaaaatgttatgtggtatgtataatgttactatatataaaattaaactataaaatataaatgtattagggaatgatacaatttgcaaaacttttatatataataaataattcttaaaatttttaaaaatactactttaaaaacaaatcacaagacgggtaaagaaattacagaacgggttttattttggaattgagttatatggtggatgtatttgaatcaatatttataaaattttaagatattattaatatgctgttttaataagggttaaaacttcagtttttaacaattgtctcaataaagaaattacataacaggttttattttggaattgggttatatggtggatgtatttgaatcaatatttataaaattttaaaatattattaatatactgttttaataagggttaaaacttcagttttttaacaattgtctcatggattcgtggtatagcgttacttaataacaattataaactgtaaaatagaaatattttataaaaataaaatttgtaagttttaatatatattacctttaaaaaataaatcgtttcgcgtgggggcagcctaagcctgatagaggcagaagaattccaacaatttctcccgctcctcaaaagtgagttgctcctcacgtacgcatgttctaatagtcgagttgctgttgctaaagcacctatggttccatccctggtaacttcaaccggtatactgcgggttaaaatctagtaaataattagaaaggaagacatactttaacaaaatcatttgtgaatctacatcatcatcttccacactacctgcatgaatattaacaaaaaagtatgtcagagaatatatgaaattaaaatttttataaaatataaacaatataaaaataaattacagatttaaaacgaaattaaggtttgtagtagaatgcgctatttcacctagtggaatgcatggtcttatatagtactgaagaaggaaggctcatttcagggttttgaaaaggaatattctgtttagtttgtagaaaaaaattttgatttaaattattataaatttttgaaacttgatgaattatagaaataattaatgagtttcttaaacataaagatttaaaatccctaaattgatgtgaagtaatttttcaaatgtgttgtaattatttttcaaaatatgcttaggatttttcaaatttaaacaatacataatattaggaatgttaactaatagaatcaataagttcaagatttgttaatgatttttttgatgggctgaggggagacaattgtcaaccccattttattaaaagaactacaaagaattacatcaaaactgctctagggaacgatgtcccgttagcatcctcaaccaaaaataaaagaacgtcctcaggacatatctcaaaacaatgaaatcctaggggtaagaagaaagcatagtttgctaacccgtcagctagacggttagcttccctatacacgtgtgacactcggactagccagtcccttgtgaaaaagccttggcacaaccgtaccaggaaggacagcggatgagccttgctgatccctgtgcttagaaaccccaccaccaattctgaatccaaatttaactccacccgtcgaaagcccttatcccaagcaatgagcaacccatagtaggcaccccataactcagctaacggcgcatcacaagacccgatattaagtgcaaacccaccgagccattccccctgcagattaaggattgccccacttgccgcagctaatccctggtgtcccctcgacgctccatctgtcgtcagtttgacccacctgtcgcttggtgccttccatcttatcatcctttctacccgagctctcttcacatggttatttaacgttcccacatgagctttccgaacctcctctgctatatccttgatgaacttcaatctatcccgacataacttgcgttccccaaatacatcgccacatcgccacttccaagcccaccatatccccatactaaagagcgtaggccaatctcccttcgccggatccagatttgtaaacaaccattcaaattgactgaaaaactcgttctgccttctttgtggcagcagcctttgccaaataggtgtcatcgccggacagtccctcaacacatgtaagatcgattcatcagctccattacaaaccgaacaagttgcaatgtcacttaagtgtctcctcacacgctccacattagtcataataaccatatgactcaccaaccagatgaaaactcgtaccctctccggcgctaccagcttccaaatttgctttaaaaaactccctatgagtggcctctcctcagcctcaggtttcagcagctcataagcggaccgaaccgtgaagtccccattttgcgttcccttccaagataactcatcacttgtccctgggaaatcatgcaccacaatagaaaataattttcgcaagatattctccagcaggtacagagttagagctcccatgtcccaccccgagcctgcaatctagtaatctgctgctaccttaggagcgcatccgccgatattgattctttggccaccgccgagagttgttcctgcaacagccaacgatccgaccaaaaacttatagttttcccatctccagggacccatctgactcccttagccaccacttctctaagtccaactgtaacacttcgccacgtggagctccagctacttttaggtttcagccagtttgaattttgcatttctcccaccttgtacttcttgctaaggactcttgcccaaagtgtctccttatcatggagaagacgccaccctactttagcaaccaacgcctacttcatctttgggttgacatatcttattccaggctaagaggtgcttcttcttcttctccaaagtactcccccaaagaaaattatgtgacaaacaatccaagctatctaaagtagcaacaggaagtattattgcactcattacatggaccggtatggttgacaaaaccgcttttgtaagcgttattctccatgccagactcaaagaccgactcttccatcccgccaagctagacgaaacgtgttccaagacttccccagaagtctctttgttcattctcttctgtaagataggcattcccaaatacttccccaactctctagtacagccaatcccactctctccacttatcaacctttccatatccctactcacattattggagaaaacgatctttgacttctccaggctgacgttttgccctgaagcctcacaaaactgttccaacactcgtcgtatgataagaatttgggctacagacgcttctgcacatagaatcaaagtcgtatgcaaaacaaatgtgtgatagtttctacccaccacacgagagtgccatcggtttccagtcccatgttcccactgatgcctctatcaagtgacaaagcctctcaaggcaaagaacgaacaaatatggtgacaaaggatccccttgtctcaaacccctagcaggaacaaaagaatcagttttccctccattccataacacactcatcgatgggtctgttaccccagccattattctgtgagtccagacctccgacagtccagtagccaccaaagtttcctgcagaaaattccatcgaattcggtcataggccttttcaagatccaattttaacaacatccaccctttccttcctttcttcctccgcatagagtgaaccgcttcttgcactaacacaatattatcaatgcttaatcgccctgggataaaattcgcttgagccggcccaatcagcttcaaaataaccttctttagccggttaactatcatcttagtaataatcttaaacaagacattacatagactcattggtctaaactgtgtaatccgctctggcttagccactttggctatcaacacaagcaaagcatcattagtagccgctgatagcaccccagtttcaaagaaatccagtacaaagcgtatcaccgacggtcccacagtctcctaacattgctgataaaaaacaggctgaaaaccatacgggcctgatgccttaaaacgtcccataccttttactgcaacgacgacttcctcagaagtaaaaggtttgagcaacgcagccttttccccgtccgttagtgttgcaaacccgcctattggcaacatgttccatactgcgctaacatcctccaaagagtatagcctcgtatagtagttcaacgccattgtttccaactccaccttatccgtcatccatctgttatcgccatctttcggcgattctattcgattcctttttctgcggataattgtggaagtgttgtatttttgtctcccaactcaatatacttttctcttgacttctgaaaccacagcgtctcctcttgttccagaaccaagtccaagtctttcaataatatctcttcttgagcaagcaactcatcggagtgcatcacatccaacaaatcctgtactgccttaatgtcagccaccaacttctcttttttgacatgaatgtctccaaagacctccctgttccatttctttaactttcgttgcagcccaagtaacgcctctgtcgtcgacaaagctgtatcccaagacgctgtcaacaactctttgaatcccccatgactcaaccaggttgcctcaaatctgaatgctcgtcatcgtggatctaacttctgatacggctccaactgaacatatagtggagcatgatccgaggacatgaaaggtaagtgagagaccacagcctcttgccacttttgcctagcatgggcacagcccaaaactctatctagccgtttagccaccatcgtgctctcttgtctacccctcctccatgtaaacttattacctctgaatccgaaatcaatcaaagacaactaattgatccagtctccaaaagctaaaaaatctggtgaaagcctcccatttccacccattctctcatccactctcaagatggtgataaagtctcctccaattatcaacagccctaccaaaccagatacaacttccttcaactctccccataaaccactccgccgactcatagatggcgccgcataaaccactattagattcatcggatccccattacagaccaccttagcgtggatatattagcttgttgacaccacaatatccacttcccccacactcgacttccatagcacccacaagcccccactctgacctgttgcatccaccctatatgcattctcaaaccccagcttctgacaaattctacctgctttttcacccccccccccccccccgcgtgagtctcaaaaagcgctagtacctccgtatcaaatttctttagcatataccgtatcgatcttctaaagatggatttattcgccccccaacaattccaaagcatacaattcatgatgacttcacataaactcataagaactaccggggagtaccattacttccctccgctactgatactatggctgcatgccccttctttcgggccaagatccatcgacgcacttccactagctggtgatctgacctcctctccatctctctgattcccaactggcagctgtgcatttcctaaattcctgctactcccattagaaaacgcacctccaggtctgcctacattctcatgctccacccgcagcctcttcctaggtgacacttctgtttgctctcctctgatcgttccaaacaccaaacctctggtagcgatcgtattccttccccctttacctttccgtccccctcctttcattggtttatagtgaccagctctcctatctgttattaccccaagccttccttttccttccactaacttcccatcaggcccacctaacctcacaacgctggttaacgcagccccatccccctcattctctttattttcttcccctgagctatctggcaccagcatcccttgttcctcttctctctttccacactctttcctgatctcttctccgccgatccccctgctggaaacgtcattccctttccttggactggcccccgcctggacagtatacgtacctccgtaaacccatcactgggttggtccccaccacttggactagcaccactctcagtactggtgacctgcaccaccggacccggactcctcttaggacaagctccagccaaatgcccaaaaactccacacaaagagcagataacattcaaaccctcataagaagcatagtagcattccccattcaccaccactgtgcctttcaaaggttgcttcaggttgaccttaacacagacccgcgcaaaatgtgctctctccttcctcagaatagttaaattcaccttaatcggtttccctaagccctctactatcgcggtcaaaattgtctcatggtagtaattgacaggcaggtttgagatgcgaacccacaccaaagtggtcacgatctcgtcacggattggattgaagtccggcgaccacgcccgaatcattaatatactgcctagtaccctccacggatccccaatagccgctgctaaataatcctcctccaaatcaaatttcaccatgaagaagcttctagggagattcaacactgacatccccccatttggcttccatagctctctcaatcgccgatttaggtctgcaatcgtgatgtggcgtcctaagactttgacaaccagacactgtaggtacaaatcgttcatcgcgtcgaggacttcctgtccaatcgtgatgatcgcttcaccttctgccccagtcagaaactcgacattcatcctcgaagccacaaactctgcactcaatctcgtctcaggaattggaattcctccacagtagcaactttgaaccttatcgacccactacggcgaccccgttaaaccccctcccggcggccggccgttctcctccatgtgctcatcgagatctcctggattcacgaccctagcggcgctagggttttctatcgacatcgccttttcaatcttttcgattgaattatggaaacagctttctaaaaaagattttaagatttgttaatgattgagttataactacagagctaattcggtagagtcttaaagaaaatactgttattttctttctttatttaatcaatttttacaccaactttcctaattaaaaccatttgtttctttttaaaatcaatttctttgaatgattgtttaacgatttgatttaaaaccaaagtttatgataattaattattttatgattgtaatatttaaaaatatttcctaaatatctcaaagaaatcataaatgctaaatcagttttgataatatttatctattttaattatacaaaaatatttaagaaatataataatattatattattactgtaatcatcgtttgttatctctttattactatttaaatattagttgttattttataatttatttactatttagttttgaaactttgacaaatactaaaaaactaaatgaaaacttcgtgaacaaattgaattagttagcatttaaggttttttgaaaaaacaataagaataatccggtacaatatttctaattaaaaacatatgttacatttaaaaaacaacatatctggtttttgttaagtaaagtttttgtttgatattttaatatctacataaaaaatatttattgaaaggtgataatgtgattggataagtaatattttaaaatataataagtattataaatccctatagtataggagtataattagttttctaatttgaaacccacgtaattatgaatggtattgaataagaaaataaattaattaaaaaaaaaagaaagctttttcttcccaaaatctggctgtataatttgatttttactgaaaaagtcaatggctactatgaaatgtaatggatgactaagattagaagttatgacccattattttaaaatccgggtcaaaaggatccgcgcgttttgaaacgagtttttttcattacagaaattttttaactcaatggcaaacttgttatttcttcttgatagtcttgttatttgtaactccaaattaagataatcaaattaaattcatcgattgaataataaattatgtactttattttgagaggagttaaaaaattaatatataaataatgtggacttttatgttcccatccattatccatttatatatgttttcttttgtgtgttttacacttatcacaaaaaagggtgtattgaacttagtattttgtaagattttgtggattttagatttggagagattttaaaagacggctagtgatttggtggatttttagaagaaataaaacaaaatttaagtggtcattgaaaaaaaagttagtgatcatttagtgatatttgatgtcaaattccataagattttgaagtattttgtgtgatagtccaaaattttttttgctaactatttaaaaactcataaacgtttctacgtgtgaatgaaaaattcaaaatttggagttgcacattggcgaattccattaattacaaaaaagtatcagaattataaagtttcattcactaatccattttttatttaacattccatttgctagtccatccatttcgaaattttgcaataatacgggggtatattcgtcattgtatgttagtattttttagagaattgataagtttataatttgcatgttttacacatccttttatcaccattttgagtctagtttcatccatctttcatagcattcaccatcatttttgtacattttgcatctttagtcgagtctaggactagtcttgcatacattctgcattttggagttgtttcaggtgttttggagctattggtgctcagaaagagggaaaacagaacagaaagtcacacttccaccaaacatactcgatcaccagtagcagagagggaagcagtcagctcagcagtccatctagacacttctactcgatcatagacgagaccaggcagtccattctgccagatatactcgaccgcagaggagaggaggcagtccattctgcaattctactctatcgcagaggcgaccaggcagtccactttgccagtccaccagttatactcgatcgcagaggagaagaaccagtccatcctgacagctgacacacttactcgatcacagagggcaagaagcagcccggaccattctgtcaaccaacctactcgaccaccagctcgaccctttgatcaatccgcactcaaccagacaacctgagcatcggaaagagaagagaagagaaggcccattcgaagcccattcgaagcccatcaggaagcccactttgagccgacactcttgatcacactgtccatgggccgtaagtgggctcgaagcccgctatcttatcttagtataaataagtctctaagggtttcgccctgagacatgcactttagagacacgaatttcgcaccattattcagcagccgcttttcattcctacaactttgtatttcgatttttcttctaagttattcagaatttgctttcattttgcttgttcatctttcgtttatatgttattgtctttaagcatgttgtctgagtagtgattaggatttctgaggatgggatagagtagttgtggaacccctggtcgaatctgttggttaagtgtagattttttgaatcccttgtggattagttgtgtttactgcttattcctttctgatcaactggaatccgatcccagacgttccagcgcccagaaggcgtttaatggaacgttggatctactagttccagtgataatcgtctctatcccaagggattggccgtttagagcggttattggctttaacagtcggttcttattgtctgcttagttagagatcgctaatgggaattaggcctgtgtctagctatgcttgaggatttctatcacgggagtaaattaatctgttgttgaacctgttgtctagggatagcttgattgagatttgttaaccaacggaattgatcagggagaccacactatccgattatcccatccttagggatttctctgtttacttacctgcttcattcacttgctattggattttagtattttttctattttcaaccattctactcgatcacaccagtctactaacagtgagactgcgtgatagagtaaactggtccatttctgcatattcactctctgtcatcgtgttgtactcgatcacagggtcccttctggcagtcgaccctgcgatcgagtatatcagtcatttctgtcattttttactgttttctgcatcaacactaggactgttagaaaaccaaccaaattctgcctggcttgacttagcaacttctgatcatatctcatctgtctgcatcacacccatttggattgacatctaaaatactacaacgacaggatagtgttttaggattaattgactaaaaaacctactatcaaaaatatatacaaactaaccatgataatgaaaagaatcaataaattaactatgatatacaatgttttgtcagagggtagatgaaacgaccattaaacctttcctttcaatttatatgttttatcgtcatcaacaacatcttatttctcaccgtcatcaacacaacatccaccaccatcctcaacatcaccaccaacagtcaagatttaattgcccaccaccctcactccaaccaaatcaatattccttctattgtcattaacataacctccaccaccagggacggcccaaaccatttttcatgcctaaagcaaacaatactttaagcctactaataaacaaaacttaaatgaaaaaatccaaaaaaaaaagaaaaaaggaactcgaaccagtcatctcatggacgttttagtacagttacacgactatgccacaagttaaatttgaaatgatgacctcaaaacttttacaatatatttgttatgcctaaagcaccagattcatgagctttagccttggaccgggcctatccaccatcatcctcgacaccaccgccaccatgctcttgaccactgccaccaccatcctcgacaccaccgccacaatgctttaataactaatatagagatatttatcaatatttcatgctattcaataaaatcgaataaattcttgcaattatgttctatatatttcatgctattcaacaatatcacatgaaatcttgtaattatgttctatataatttcatgagattcaacaaaattacgtgaattttcacaataatgtccaaatttctcaatataccatgctattcaataaaattgagtgaaatctttcacaacaatgttcatatttggcaatatatcatattattcaccataatcatattcatttttgcaataatgcctcctcaaccctcgtacattttctctgctacctattgttctctaattctgaaaaaatatagaaatgattatttggtaaatgtccctcttctaaaaaatcagtctatggttaatttctgatagaaaacaagtcaaacattattttcttaactattttacagttaaaaggttattcagtaatattaccctattttttattttcttaggtcatcttctcagtccttaagtaaattactcattttcgcatcaaatcgattttgtttgttctctgctttttggtttagggttttagcttttcaaagttaaaaccttttttccccccgaagaagaatcaatacgaccgatcaaatcaatccattgaatctatggcgatggctatgagacttccagcgatatctagagctgtgacggaagtagcttcgtctccggttggtttgagacgactgttctgttcaaatgcttcaaggttctcttttctgtctccaccggctcgtcgtcaggctgaacctagcaccaatctcttccactccggtaacaaacccttttcatctctcagttaatttctggttctttcgagggtttatcgttgttcgagtatatgtttgatgctttttaaagatccttcctttatgaattcagatttagattatcaggttcgtctaagatgaactatatgtgtttaagaatttgataagttcaattattcatttttggttctgatttccagaaaaatgtctgctttcgattgcttaactctagaaatgtattgtaagagttaaagagagtttctttgcactcaattacttcagaattcggtttgttcggttaaaatttggatgcttacgtgatgatatgtgtaccggatcaatgtcttgtttcaagggtctatgtgggctgtttctagcatcttcaaggcttctgtttttgtaaactacttcctagtatcaattagtttttgaaatactgcttaacattgggctttgatgcaagcaattttgattaggctcttacttttgttccttcatagcctctgtttctcacttttatcacatggccattatcacatacatacatctaaggaatgttatgtgttcgatactgtgtctcagtttcgtgaaagtgtctttttgtcatgttatctttatctttgtgtcactggatatttcagggcttagtaagcgcatcacttctgaaaggtccttatggaaccgaatattctctcggaacatgggtggtggtccgagaactttccctggaggactaaacaagtggcaatggaaacgtatgcacgagaagaaagcaagagagaaagagaacaagctcttggatcaagagaaacagctttacgaagctcgaattcggaccgagatccgagctaaaatgtggggtcatccagattccggtgagaaaacggcgaaattgaagcagagtcatggaccaatgagcccgaaagaacatatcaaaaccttggctgatcggtttatgaaagctggtgcagatgatttgtggaacgataacgatggtccggtgaagaaatttgatcaagggtcgagatcatgttcggattcaattgattctacacctattgatgtgaggagattagtttctgcgacatgtgattcaatgggtaaacatcgtgttttggatagtagtaggagaggtttttcgagtatgagtagatttaagagaaatgagagttcttgtgatgaaggagatgacgttgatgctaaaaagttagatactttgagtcctttttctcctaaattttctggtaccaaggagaaagtgaagagctcgacgagtgttgttggagttataaggaacaaaggtttgtttggaagaaggaagtttaggaagaacgatagttcaactgaagaggattcagatgaagaaggcaatgagggaaagatgataggttggatggatttgaggaaaacaggaagcagtgcgtcgttaggaaaccacgatatcaagctgacgaaaagagtgaatcgtaatgtcacagacgaagagctttatcctcctttggatattaatagagttagagaagatctcagtaaaaaacaatctgtggataatgtaatggaggagaagcaagagcctcatgactcgatttacagtgcaaaaaggtattttaaactcgctgtgtaaaggattttgatttgtcaagtttgaatcttgatgagctctgttaatggttgcagatttgatgagtcttgtatatctcctttgacgcttaaggcgctttctgcgtctggcattgttaagatgactagagtgcaggatgccactctctctgagtgcctagacggtctgtgttcttctagttcttttggctcaaatggtttgcatttgacaacgtattatcctatatgtaacgcaggtaaagatgcattagtcaaagccaaaaccgggacgggaaagagcatggcgtttttggtattttacaatcctttctcctgagattatgccttagcttttgttgtttcttaagataacgttgtaagactgaaaaaacagcttcctgcaattgaaacagttctgaaagctatgaacagcggtaagggcgttcacaaagttgctccgatttttgttcttatcctctgtcctacaagagaacttgcaagccagatcgctgcagagggcaaggctctgctcaaaaaccatgacgggatcggtgttcagactctaattggtggtacgcgcttcagacttgatcaacaacgcctagaatctgagccatgccaggtttgaccaaccgtgattccctgtttaacaggaattgtttatattttctagttgttgtggtgaatcttcttttgtttccgtaccttgttgcagatactaatagcaactccgggaagactcttggatcatatagagaataagtctggcttaacatcgcgtttgatggcccttaaattgtttatagttgacgaggctgatctattgctagacttaggattcaagagagatgttgaaaagatcatagattgtttgcctcgtcagagacaatctcttctcttttccgcaaccattccaaaagaggtacaattgctatatagctaacttcatatattcttacctttatcacaaaatccaatgcggacacaaacgtctaaaatgtagtttaaattcaggtccgtcgagtctcacaacttgttttaaaaagggatcactcttatatcgacacaatcgggctcggttgtgtagaaactcatgataaggtaaactcttaagctcttctttttgtctcaaaagcttgttacttgaatctggttattgagtttcttgctttggttttaggtgaagcaatcttgtattgttgctccacacgaatctcatttccacttagtacctcatcttctaaaagagcacatcaacaacatgcctgattataaggtaaaacaaatcctcttaaacgattgcttttttatttctgaccttggtaattctcgtaactatccaatttcattctcgcagataatagtcttttgctcaaccggtatggtaacatcactgatgtacactctgctccgggaaatgaaattgaacgttagggagattcatgctagaaaacctcagctccatagaacatgtgtatcagacgagtttaaggaatcaaatagacttattcttgtcacatctgatgtatctgctcgtggaatgaactatccagatgttactttggttattcaggtaaagcacaaagcgaacattttcatgccaaaaacaaccttttatggatatttaacggattagactttgttttacgtttttggtaggtcggtataccgagtgacagagaacagtatatacatcggttaggtagaactggaagagaaggaaaaggaggaaaaggattgcttttgattgcgccatgggagagatattttcttgatgagcttaaagatttacctcttgaaccaattccagctccagatcttgattcaagagttaaacatcaggtttgttcgccttcactgtcaatacccataagtggagttttattgccaagtgacattgaggacaattgatttttgactaggttgatcagtcaatggctaagattgatacaagtatcaaagaagcagcgtaccatgcatggctcggttattacaactcggttcgagaaaccggtagagacaaaaccacgttggccgagttagctaatcggttttgccattctatcggtttagagaaacctcctgctttgtttcgaagaaccgcggttaagatgggtcttaaaggtatttctggtattccaatccgaaaataaaccgacccgtgttggtacttagatgtatcgtcgtagagagaaatgtatgaacacatttatggtcaacatcatgtttaaataattttgttatttatttatgaatatatgattaactttttaattacaggaatttttgtttgtctaagtcatgtgtttatatatttgactactagtgtaatggcctaaatggagattaattaattttaatatgtacattacagatccttaagcaaagtaaaaacatacattattattttactaaaaaatgtcccacgcgatgcgtgggtgaaatgaatgtagtgaaatatatgtctataactaatatatattaatataatattaaattattttataatacattcaataaaaaatatcataaatattgtgattatgatattttagttttaaactaaacatttagtttatgaattataatctaaaattattttgggtatttataaattaaaaattatcgaattgataaaaaagaaaaattataatattgatatacaagataaggcttgtgttttatttaaatatatgaaaatgatatgcaatatttctctgagtaaaagatttcataattgtatatatcatattgattatagtatgtgtgtaaattgtaaagtagttaatagatttgaagttgtgagattgataaagtcttgattaatgagtaagattaacatatatgaatattgatatattaatactaattgatatcaaaagaactctaaatactttatacaattaatattcaaattatttactatttcttccatctttgaacaatatggtaagaaagtattgaatttatttactaatgatttagtatatacacatgatttttaataaagaagtttaaagttatttcgatgcacataatcaaatactaaagaaaatataccataattcggttgaaaactaaataaatttaaaatttaaagtacaatgtaacaagtaacaacatacaaaataatttaaattaacagaatttccaaccaatgatatcaatgaagattatatattttgtatagtttcatcattcatcaaatctcgtaggttctatattatctttatccatataatttctttctatattacctcatttgccaacaaatgcatcaaaagacgaattattatggtcactataaaacttaagaaacgaaatatagtgtaaatttagcatgataagtaaaagataaacattttttcaattactatgattagtaaaatgagttataagttactgtttagtacataagatcaataataaatcaaatgtgtacaaataggaataatgtttgtatattaaactataaactaaatgaaaaagacgaaaattaaagaagtagccacacattaaaataaaaagtgaatatattaagcaggaccaaccaggaaatatcatatggatccaataaacatttggctatatatgtttatcatttggttgagtattcactgttgttattttttattgaaaaactaaaataattttaaagattaatatgaattttagcaacttgacataaatattttataaacaacattggtcaacttcaaaacatgaagaataagtagaaaatgaaggtaaaagatactttgtttctcatgtaaaagtgagaaggtaccttagacatttttcatcaagtcatttctaaaggaaatccacctttcacatattcacttatgcatatactataaaatttgactcaacctctttatttcaaaacctacgaaagtcacataaaattttgttttaaaagatatttagttaaatatatatatatgtatatctattaatactatgtttatatcctctattaaaatatcggacatgttcataaaatagcaggttgaagacaccgggttcccatgtcgaaccactaaagtgaagctaaaggcctttgacaccatttactaaactttgaaactttgactatggttgtgactcgaatagttaaaacacaaatagctggagaaaaaattagaaccatgacattaataattaaataaaatatacatcacagatgagcatcgagcaacacatatatgatttgcctacctattaccttcatcatgaacagaaattctcagtgttatgattgctaagaaattcttagtgtaataatttttaagccactttgtatctaccattgcacctataaaaggatgtattagcaaaaacacatgaaacatgttataaagaagagaagtaacaaagtgtgaatcagtatcaccacatttggacgatacaaaggctacacaaaacaaatattaaaattataaaaatgagagagagaaacttgattttagttcatttctttggtgaaaatgagaaaaataaaaaacaacgtaatacagaggacgaagcaaacctttgagattaccattctttggtttctccaatccgtcatactcatatggttcgtgctttgtcttttttctctttactttcaatttaattatgtggaaagacttagcagaccacaaaatattatttcgatgtttaaacaatcccgaaagcaacacagaatgatagaagcttaaaaggagttgtaagaaacaaaccttgaggaaccgatgttgatgttgttcctatgaagaatcctaccaggagcagcgtcaccaccatcgatcaactctctaagcccccaattctccacctcctcttctttcacctccttcttcttctccttctccacatggcggttattaggaagcttcacaggcaacctctcgaagtaattcccgatacttacgatgcacgtttttattatcttcgtatagaaagaatgaagcttcaacctcaagcgttaacaaatgcagagaaaccaacttaaaaaaactgacatgcagcgtcttgcattttataaggtgaagggttacactaaaaatgatattaaatatgatactaaatattgaaatcatggtcataattacataaatgataattatgttagtgtaacgtaactgctttgatttatgaaatagaacagtttagttgactaaaaaaaaactgcaatagttagacataataaataaaagaaaacgtgatatcacatgtgtcattaaatagaatattaacctcacaacataactgaaacgtattatgagtaattcattgttttttcattcaatttattatattgtaaatgatatttatgacttaagttatatggtcagttatgttgtttattttgtttcaagatatacaaataaacatttaatcgattatgtgagaggccaaatttttttaaaacaaataaacaaatgatcatattgtcaacaaacacataccataatctactcatacattttttatattttgaaggtattttagagaaaaaatatttgatctttggtttgaaagataaaactaatattttattctttaattcttgagaaattattttgttgagaaattctaatgttatggtaattatataaaaatattgataaatgatacatttttaggaaaaataattatttagaaaaagtgcattgcaaaaatgttataagttttttttattataaaactgtaattaaactcaaagaatatggaaaatagtatatttaaatttgagaagaatgacacatgtcgaatgaatagagcgccacttgtcagatttttagagtacaagtttgaggaaaccttactttattatataagatgtggttggttacttgttcgtcttcttaatttttcgacaattattaaataaaattgtgatgattgaaaactatataataaagacaaagtttgggaaaataaaaataaaataaagaaacgtgcgagagagtataggtggtagattctttttcagcttgttcacttgagtataatttttttttttttttttttaaacattatattaataaccgatacaaatgttatgaccaaaagtcacacagttttttgaagttcgatacacaatatagccataaactaaaagtatatagagataataaccaaatcatccgcttcggttaccttttgagatcagcataatagaaccattagccacgtccacggttcccgcgtccacgatttccgcgtccacggttcccacgcccacggttacctcttcctcgagtagtagaggacgcttgtatctccttagctttgatggatggtttaaccggtctttcgcgcaaaagacgttgtcccgatggagtcataagttccatcaattctgacccactgtctgactcaactgaaacaattgagtcttcatctgaatgaagagaatccccatcaggaaacgaagaacccaaacgactaaacctgttttcagcaaggacgtgtcttatctcacaatcactaagaatcacttatcttttgtgcctgcaatttcgaaaactgattcaactgtgcaagtttcctcagttacaacttcagcttcaacatttgtaaagcaatctgccactccggtgcaattatctttgtcttggattgggccagcctcaatatcgaagactgtatcgatttggatttttgaatttgtgattgggacatcaattggggtcttggtttgaagagtgattggcgataccaaatttgtggcactagctaaacttacaatagcaggagtaatgatctcctctgagacaatttctgttactttttcatgtgccaaatggggtttcatacagcgcgaagccttatgccctaactgcccacattttccacatttagctgggatccaagcatattcaacattaaccatcgatatattgcctttcttatcaactgcggcaattcttggagggaaagctttactcaactccacttccaccaagatattggcctcactcattagggaagggtcaagtctaggtttgtaagtagccataggagcacctaaacctgatgcaatatggctaattcctagaattgagtacaaccggtttgggatatttttaagggttacccagacaggaatagttgatatttcaggaagatcaaatgtatttacagtagaccaaggcgctacaaacataagacaatcatcaacatgccataagcccctctgaagaacccaagctctagttgaagcatccgggatgtgaaaaagaaattttgagtcacctaatttacggataaagattctacactttctaccctaaattttattgactaccgcatgaatcaaaccaccaggaggaggactacatctatagaactggcctaagacatattccttttgattcacaagaccttgcaagaagacatgacttggaatcgttacctttggaattccgtcttccatgaattccggcgaggttgccctgtaaaggttccttgccgctggatccatttttgcagcccaagggaagcgaacattatcctccttagttgcttcaagatgagattgcatcggtgctccaccaacatcttgctgagaggccgatgacgaggtgaactttagctgctttgcccaagctccttttagagtaggggagaccaacttaacaggagcaatggactcgtcgagagtagcagacactattggcggtaaggcggaagtaggaagagacacttctgcggaataagacaatgatgtaatactcaccacatgttcaattggaggctcgacagtgaccggtaaggtcgaatccagcgaagaagtaagattcacgaagtcaagagaagaagagcgagcaattttcggcgaggatccaattgtcaagggtttcaccagtgagatagaaggagaaatcactgatggagatggagaaggagaattctgcgtccaccgagtcaagtacggccaccgtggatcagggacagagttgacattggaagagtctacgactacaacttttggtccgacctctgtttccttgccttgagttaaaactgagacagaattcatcgagtgggatactgtgaagtgattgattggaagtaggctctcctaagaagattaagagaacagccggcgacgtttcgcggtggttacagcgaaacaaattctcaggggctcctcttggctgaagagtaatctcatacactcttcttataaagagcattttctttttgattttttttattccgtaaaaaaagtactcagaaaactctaagaatattgattaattacgacccaaccagggcaaatggatcccaaaataacccaagcccactgttttcgggtcaaatccaaataaaaccctaattcccctaattctctgcggtaaaattgattcacatctctttcttccctttgttttttgtttcttccttatttcgtcactgtaaaatccagtaaaaccattctcaattctcgtcaacgacaacaacataactgttcgtcgatcttggtatatctacaggaaactaagaaattgggtaagtgatttaattgttcgtcgatccgagttgtttcagattgggttttgtgatcgaaattgactgaagagtagtgctaatccaaatgattttgtttgtaggtttggagaaatggctcgaacaaagaacgcaggtgtgccattggcggcagaggtggtggtttcacagacaatcaatgacgaagtagtagtagcatcggctgctgaagtggattctgaagcaacaaattcaatctctaacgacgatagagcgatatgaactttaaactttacacaattagaaaagtataactatgtatgaatttggtatatctttattgatattgtaacttagaaattttaaaaagtatatctatgtataaattagtatatctatgcataaattgagtatatcttttttgaatctaacttagaaattttcgaaactaaaaactaggtatatctatgttcgaatataacttagatattttagagactaaacaatatatctatgtataaattaggtatatctatgtggagaagttcttccttagggctgtggctgatctagagttgtgcaaaacatttccgtggggaagatttgcatttgaagaaaatgtgaaagacattttctatttgattaaaaagtgcaatgaagtagttggtccacaaaaggtgtttcctagttttgttatgcctttggaggtatgtcatttcattatgcatttatgaattgttttaagaaagttaaactatgtacaactgtgtttttattagcagttatacttattagtttttgaaaaatcttgtattgtttttttgtagtatctagcatttgaggcgatcccagttctcagaaaaattttttgcgaagatattgaatccgcagatcctcagtgttcccggatgtgtaaaaggaagtttaaatcaagcactatgaaagggtttccaatgtcagatgtgtatgacaaactcggtacaactaaggttagtgatgacatatttattagttatctatcatgtatcatgtatgttctatcatgtatgttatattaattggactttcttatcatgcacaggacattcagagtatcttggcttcaactcctgatgagaagctacttttggaaagaattatggataaggagtgtgaagtgaatgatgtcgatgatctaatagctgatggctggaagaaacgtctagttgatgaggagaggactatatgttttgaaccgttgctcaatgaagatgtagcacaccggagctttgtggctaataaagctttgtctactgtggtaaaagctccaagaaaagccgcagtggaaaagaaaggcaagggaaaggctgctgcagctctgactagtccaagtgatggaggtttgactgaggttgtaaacgaaatgaagaatttgatggagaatggatttaagtccatgaacaagaggatgaaagatttctgtaagaagtatgaagagcaagataaaagactgaaactgatggaagctgcaatcaaatcaattcaatcaggcattggaactgaagacgcttgtggttcaaaggagattgatgataaagaaaacgagctggaggaagggagtgatgcagagactgagatagacaaagaggtggctcaaggtgataaggagagagaggttggagaaacagagactcagatagacaaagaggtggctcaaggtgacagtgataaggaggtggctgaaagtgagaaggacaaagtggtggctgaaagtgagaaggagaaagaggtggctgaaagtgagattggggtggctgaaagtgagaaggacaaagaggtgcctcaagatgatgagatggatggaggtaaggtggctgagagtgatggagagatggatggagagaaggacaaagaggtgcctcaagatgatgagatggatggagagaaggagaaagaggtggctgagccaagtgagattggggtgcctgaaagtgagaaggacatagaggtggctgatagtgagaaggagaaagaggtgcctcaagatgctaaggtggctgagccaagtaagaagcgaggaaaggcacatgaggatggagatgatcctagtaaagagggagttaaaaagccaaaggtggtcaagaagctggcagagtcgaggacggatgctaagccggtgtatcggagtcctatacagacgaggtataggagaaaaaagacaaagaagaatgtttaaacaatttcaactcttggtttgttttaggtataactatgttggttgttgaaaacttggtacatctgttcgaacttggtacttggtttttttttgtatttctccttatgcttttgaaaacttggtacaactgttgaacatgtttattaggttttttgtatatctacttatgttaatttcaaaacttggtataactgtttcatgttctattgttttattttggtatatctacttatgttttgtaacactaggtacaattatatgtttttgtaattgataagaaaagaattttaaccgaaataactagattcaacacaacacttagtctttataattagattcatatccattcatcacatcaaattcaacacttagtctacataattaaacattacaacacttactcttcataattaaacattacaccacttaggcttgaatttctacgacaaacacaacatgccaacaattgccatggtgattaaacatccacaactaaaaacgattaccatcttaaagtcctttccctttttattcttttccatcggatctctttccatcgtctcttggttcctatccatcttcatcactcttacttcttcttcaagaacaccgagttgaaattccaactgttcaatctcatgtgtaaaagcctcatctacccacttaaacacatgtttgtcgttcataagctacattttgaaattgtaaaaattgttaaatcacatgtatatctatgtataaactaggtatatctattaagtatatctattaggtatatctattaggtatatctattaggtatatctaggtattttagtgactagtcaaattattgtcaattgcatatcagaaatctataagtgaaacgtgaattgaatgaaaaatgtacccagaaaaacgaaatgcttacccaaataattccactcttctctctttttctctcttcttctctcttttgagtcttctctcttcttgtctcttcttgttctttttcgatttgattttttttatttttgttaataatagggttttaaaaaatttctgcgaattggggagaaatgaaaatttaggggaaattttttttgatagtgtgaaaaggaattgatagtgtgaacacgtttcttatagtgtgaaaaggaattaaccgtgggacccgcgtacgagttgttcagaacaaaaagggtggggcccgcaaactctttgcacacagatattccaagttaacaggttgtacctgtgtatacacagtttgacttttgtttttttttaattttattagatatacttaaatttaaactaaacaaatttagttataccaaagagttttgatgttttataaacattccacatattttcatagaaaaatatgtctggaaaattcaattttgtgtgttttgcaatgttatgatgataataattataaagttatcttcaaagtgtaaggtgtttcttttataacaaatgaatttggtaaagactaattttttgaagtttcattaaattatgattttattaatcagtagttttaatactcaacataaggggtataatttgtataagaaataacatcacatcaaattttgttgcaaattaagcacatttgttacatttgtcatagttgtacctttacaaaaccaagtttaatcaagttttacaaaaccagagagtacaaaaaacacgaatttagagacatacatagttctaccatttaaaaattaagtttaaccgagttttacaaaatctgaaagtacttaaaaacatgaatttagagccatacatagttctaccattagagaataaagtttaaccgagttttacaaaatctgaaagtacttaaaaacacgagtacattaatttccgcttgtgtattggccactcccctggctatcactttcgtggtttggaaaaaaccggctctccaagtttctgcctttcacacgcttattcttggggcgacgttctccaactgatgggtgtctagtttcttgaactcttccctttttaacaacatgaaccggaggatatgcaaacaattcttggatttcacttggaataactcactctgacttatgcggcaccggataaatggttctatcatatgccataacccacatctcaacaaagtaatatttcgtgatcaaatcatataaactttttacctcctcggatctatctttttgtttcaagtgagtcatcacagccgctattgcatgtacacaaggatacttgtccaagtcaaaacaacgacaataacaacttttattcctcaagtccaccacataggtcttaccatcgcgaccaatgacactatattgaagctcgtaggtgttaagctctatcaccggtaatttttgtgcaacttcacatgtttcatgtatctcgttctccacaaaaggaacaagtctctgtaaatttgatccacttaaggcttccttcctattattgcagctccattccgcaaatttctcaataattgcatctatcataggtaatagcgcataccctctcacatccctaaacacaccattcatagactcaaccgcattactagtgtcaacgttgtactttactcccggaaaatgacatcttgcccatttttccaaatcagtgttttcatcaagataggtggctaccttagggtgccttcttctaaactctgcatattcatgttcaaactcagacactgaacaaatggatgcaattcttctgaacgttttagcaacctcttctttgttgtatgcaacttttgttctcacattctgtgacaaatgatacacacagtttccatggtgagagctcgggtacacctcagccactgccttgatgaggctagaatttctgtcagacataaagaccaattccgaactgtctggtataacggttttgagagttttgaaaaaccacttccaagtaacatctttttcgccatcagctacagcaaacgctaagggataatggtgatgattcgggtcttgagctgtggcaaaaatgagcacacctttatatacagtcttcaaaaatgttgcatccacaataatcacttttctcatgactttaaatccttcaatggcagcccccaaagcaacaaataggtacttgaaccttttttcttcatctaataccacactagtctttgtgccaggattcaccttctctaacaaatacaaatattgataaaccatcttgaaactctcctcgggactagcacgaatatcactaacagctagtttttccccctattagtagtcgagtatgacacagttgtaccatgttttccctgaacaaggccaatgagacttttaggagttggggtcttgtactgacatagataatcttcatgcaatacggttgcaactaaacgtggtgtacctctccttttaatgcctgtagcagtattcgaccgtacacatgtatggaacttcctatatgttcgaaccgagaagcgagttgaatccttagccttcgaaaatcgtatgtaccattcacacccttattcagtacattttaccacataccgcttcttatccgagttgagtaatgttagtccaaaacaattcctatttgctcctgtcacatcatcgctattttcaaattcttgacctattactagatcaagaccatcatcccatggacctttaaacttagaatgttggctgtcacgtggttcctcaacatattcacgaataccatcattctccttactcatactcatattactattaacaccattatccacatctctaagaggctccaaaggctctaaaggctccaatgtctccaaaggctcagcaagttgttctcctagtggctcatttgcgtaaagagttatagcaccaacattagctctatcatcattatctagaccaccaaaattctcctcttcataattcacaccaactgaactctttccttgtactctcgattgttgctcgtttaagtgaaccatttccaactcataccgacttctacatgcaagacacttctacttttctcttcatccaacgtggttagataaacatatacatcatcatcatccctaatatataaatatgtaggaggtttaacacccgttggaatgtaactcaatttcagcttcatcgtagattcatctatcttcatctttgtgcatatcttatccactaaccacgaataagtaatctcctccattgatgatgtactaaacaatataccatacaaaccaactacttttggattccattgatatgcttctccggtttttgaataatatccatcataatcaaaatatatgattatgcccattctcctggaaaaaacaaaaaaaaaaacgttagctatacttagattttcctgttctagcaaattgtacttcgaacagctataccacgctcattttcagaaataccagttatactattcaaacagctataccacgctcattttcaaaaataccagttataccatcaattgtacttcaaacagctataccacgctcattttcagaaataccagttataccataaatagtgcttcacacagctataccacgtttcttaggtatacctagattattctgttctagcaaagattttcggaccaaaaacagtaatctgcctaagattaactacgaatcaaccattacagtacattaaaatgtcttaatagacccagaatatatagttaccaacataatgtctattaatttccaacaccaatttcaaatctatcaaatctaattgaaatctacaaaattcaaacacaacaacacaagacttgatgaattaagatgtccaaagtataagaagagaatggtaaagctcactttgaataacagaagcaaaacgacggcgagcttggtcgattggattcaacgtcggaacaaatcgacgttggctgcagtcgtcgatttagattttgtgagggaggaaaagaaattctgggaatttctgataggttaatattttgtgacttaaatggtattggtttggagacttaaccgtaattggttggtttggttcgtccgtccggttccggtttgttgggtaaggtaaacaaggatttttaaaattcattaagagtataggagtatgttagattatatgagagtatttagactcattgtccgattacagctccgtcgatttgatctgaccggagactaggtttcgccttcgagagaaaaattaggggcgcgtgtcacacaccatctttcctttcctctcaaccgctatcaaagattgttcatcctgaaatttggttgctttctttcatcaacttctactttttttctaatcagcttctcgtccctcaattccaccgccaacaaatcatgttcttttttctctgagatagttgaatcatccacaaaaatttttgatttcttatctgatggttgagatttaatatcagagtggacatccatctactgcaagtttacccacaaggcagcatcaatgagtgaatccctgagtaaaaaaagaagtggaggaaatattagatcttataaactaatggttaaaacgaaaaaaatttacacatgaactaaaggtgaaaataaaaattacccaagatctttaaactaaagattaagcaatagtgatgatctccttaactttattcatcccaataatctctctaataatgtttgcaaattagaaaattgcataaagaaataacttacgtttgtatgaagagaaaaaactgtagataataaaacaaattatagcgatggcaatgatgtacccataatataatatcctacttatatcctactttttactttttacagaagcttgtatcctacttccatgtttcaaaataaaatataaaccttgtcactaacagtttacatcaagttataaaagaatacattgatttagacaaatatccaactaaaataaatttaattttataaaaaaaaaatatccacaaggtcgtttgattctaatccaagtcattagtagtttgtaacgacaaagattagagaggcggtttagtatatgtgatactgtttcatatagcaaagaatgaaatatagaaaattgaatcaaacgaacctcttataataccaaacttttaaagatggtaaaaactataatgtagtagtacaacagagctctacattagtctcatcagttctccttcttctaagtaaatcttaacataggtcatgatataatagattttagtgagacttcagaaaaatccacaaaattgtaccttatcatctacaagaagaagattcaatccagtgaattcccttatttatccttttttttggggaaatccccaagggcacttctcaccttgattttacatcgatccgttactagagttatatgagagataggtgtaatattgagtgacataattggagattggaatttggaatatgaacctacaaataaaaagttgtttttcttaaatagagaattttatgagcaagagaaacttatgcaatttagataaagagaatagaccatgtgggtcagtggttcgacacagtaatgccaaaaattctaaaatttgcagacacaataacaccaaatcacttgagagaagataattgaactataacaaaatttacaaacctgagaaatacgaaaacttgtaaacttgcatagaggaagagacatgtgattgatgataaaccctaaaagtaaatcatgtaacgacatcatacccaaagatgaattggaaaccaagaagggatgatgtgaagaggagaggcaaagtgagaggcggaagaaataatgatactttttcggttaaagaggaaaggttgaaagtgaggaataatagggccatgtttgtttgatcatttggaatttgcatccaaatgatccatccaaataatccatttgaatgattcatcttaatgatgtttgtttgattatttgctaatcatttgctaattcatctaaatgcatcatttagatggagctttgtttgtttgatcatttggatgaatcattcacattctcatatatatatatataaatgactaaaatgccctctgttaagtaacaaataatcaataactacattctcatattaatcaaagtagagtcttaaaaagagagttctctgtttccattttctaagttccttcttatgctctgcagttccctagcccgaatgagtactcagcatttatgggagacttctcaacctgcactggtgttgcaacattcacaatgatgctacaatatcaatgataaagaagacacagtaaatggttgttagtaatagtgattgatactattcaatgattgatagtactagtgattgatactattcaatgaaaggaatacatgagcttagagaccaaccaatattcacgtgattcaattatgacaaaccaagcttaaagacgtgatcatgtgaatactattatgaatcttttacagaaatacgtagatacagagacatgtgcaagtgaatgaaagatgcagaacttgtaggccctttgatgttctgagagaagttaaaaccataaacctgaagaaatttcaatagattcctagtgtctagattagttagggaataaattgggaatgagaaataaaactaaaacgtctaaaacctttttttcatgagaatctaacaaaagatgttgcagagacttgcccttatattcatcaagttattcattgtgttgtactatattagtagtgttactttgttgttcttatggttgcaaagaacattgtaaacgcatctagattgaaatatagtttcaacttacgtagaaagcgatggatcaaacgccctaactatctgaacatggcacattacatgatctaaagatttaggatctaaagaagtgggaaggctttgctaaaacgaaggttagctaactccttaaactcagacacttaacagttacatatcatcaccatttaaactccttaaaacaataacacactaaacagttcataaacgaaagaatatatgatgatgacttacagtgattcttccttcaatccttaaatccttcaagccaaatctggatcctagctttctgcatcaaaaacacaaaagacctataatcaaagtaacacaactaaagctaatagaataatcaaagcaacacaaagcaacataagcaaaacaaagccgtaaactaaagctaatcgaagaatcaaaagcaacacaaagcaagcaaagcaacacaaagcaacataagcaaaacaaagctgtaaactgtagctaatcgaagaatcaaaagcaacacaaagcaagcaaagcaacacaaagcaacataagcaaaacaaagctgtaaactgtagctaatcgaagaatcaaaagcaacacaaagcaagcaaagcaacacaaagcaatataaggaacacaaagccgtaaattaaagctaatcgaagaatcaaaagcaacacaaagcaaagtaaagcaaacccacaattaaacaatgtaaccatggtggatcaaacccaagaacaagtgattgcaacaaggatacaaagagaaacaacgagagagacatggagcgagagagaggaagcgagagagagagagagagcaacacaaacctgtacactccggcgatggatccgacgagtctccggtgaagagaatcggcgactgcgagaaaaatcggcgacagcgagatcacctcgacgacaatgaatctcgttttcagtgttttgtgtcgtggagatgctgaagaagagatgtggtttttgggtgtaattccatatattagattagggtattattgacattttacaattttggctgaaccagcttcagcagaatgaatagattaaactcagtcagattttctttattttttggatgagtttagacaaaagcattcaactgaatcattcaaatgatctcttaaaacatgaaaaacaaacatcagttttaatcttcattgagatggtttatccaaatggacaaacaaacaggacctagatcgtgtgactgaatgacccgagcagttgattttctttttgtcgtaattttttttttaacttaacaataaggtgtttccttttacaaattacaatcttgaaaggtgaaaaatgagacttatgacaggtgtgagaaggagaatgtgacagttttttgtaaattaacttgtgatttattagataaagatttgaggaagtttgtttattatttataatcgttacaattgaaatcatatatataaaagcttaccaactctctccataaaattgacacataatcaatttagcatttgccatgtgtctattaaataattaatgtaagctcttcaacttctaatttataggttaatgatatatttattatttaattttatatacgattttattttatatatttaattgtactattactaaatttgttttaatattacatgacctttcaataaaaccattttaatagttttctcatactcggagattttttttaatccaaactcaaagtatgagtgtataatagtcgtggattacttaatgatttaagttagttattctcttaaattgatatttagattctcttatattgatatttatgtaataaatcactgagggtgaagaatacgtaaggagctccatcatcaaattcttaggtttctggaatgcaacactaccctctgttaaattgatttaagagaagcgttgtttatgaattctgtatacgatgcattgttgagaatgttgttaagaaaatattttaatactaaaagtaattgcttattgcatgagtgaatgattagataaataaaaattatatttaaattaaacaatataaacaaaatccaaaaaaatgcggcgtagcgcgggtgaacacctagtgtaagtaagggaaaaattgctcaataataacatcattgatctcatttcaaagttattaactaataaattaagaatgaaaaatggagttaataatttactaactaaccgcattaatgaataaagataattatttattagtatatgatcttttatatactaaatacacatgcatctagttcaagctaagtgaaggaactattttcagagtgaagcaacctttccaaatttataacaagagagttccaagtaccaaatatcaattttttctcactcttaattgtcaccatgcaagtaacatcttcaactacacatacccaaaaatttgaaagatttcttattttttgttttatttataaaattaattggctcatacacgcacatatcgtcgaagatagagatagtttacggtgacataggctgtacgaagttacttttaagtccatcgtacatcaaattttgggtttaaatgttagatatgcaattttttatatgggatataggatatcgatgatttttttttttttttgaatagagttggtgttataatttcatgtgttggattattcatttaggagtagtagatttttcttctttttttgaacaaattaggagtagtagactagtagtcaaggtttgttcattatcgaaaataaaattcataataacagcaataaaacttataagttataactccaaatgacaaggtggttcgttgtattttgctagaaatataaacttgaaattttcaaataattagtaagttttagacattaggtattctcacaaggcaacattccgaaacagtaggagctaccacaaacagcaatttaatttgttgtccgtattttttctggtgacacggacatctccataagtgataatttaagtcgtcctcaataaatttagttttgtttacacataacatccaaacttttgttttataaccttaaattgaaagtaaaaatattttgaacagtaattgtattccaaagttttttttgtttttttttttgcttataaccaggagtttcagggccgatgtccttattccccctcaggatccgggtaagaccaggtgaaagcccctggttaagtggaaatgactagcaatttcgcgtttgcggggaatcgatacctggtttggaccaacagggcaaccaacagggcaacgcttcctcaaatgaaaccactagagcatgaccacttggtttcttttccacaattgataataaataatcaataatagactgattggtaccatttaaataggaattttatttgtcataatactcaatctatttacttttggaattttcataccccaactttttggttagaagaaaaatacttcatttaaaatatctttgtctaaaaatacttcatgttgaattattggtggattcaagtttacgacttaataattattaacaaatattacaaaatcatttaacgacgttaaatgttaaccatgtgtatataaatagatatatagactttttattcaaaatcttacaaatatattggtgtggtctagtagtaacaagtagtttatttaatgttactgcgttaatacgattgataagcaggttttttacacctacttatatgttgaatgtgtgtgttcagttcaattcctctaaaacacaaacatgtcgctgcagttatagagggtgtcaatccagtccactgtattactatcaatcaagatgtgtacaaaaacaactaagtcaagccaaattataaagatggtgggtttctagtaacaatcctagatcaggattcaaacaagtaaaaatgagaacttaacagctctactcgatcaataggtcgagtagaaccaacaggtgacaaaattaagaactaaaatgcaatcaacaggggatgcaaataaaggatacaaataacaggtaaataaaagtgcaatcaacaggggatacaaataaacctaatagaagttctaaggatggattcattgataagggtaactctagggttcatcaaatggctaataggcgaaaggtagatacccatgacgatagattcaaaaactgggtcaatccactctcgtgacagagacccccataactctaccacttcctaatctcaactctcgttgatgaaacatagcagagcagggtttaagaaacaatctaccaaagccaataggcagacaagtcaatcccttggtcgagtctacagatctctggaattcgtaggcagacatccatttgaacgtcttttggacgctggacgtctatgatcgaatctccacattagccaccgaaaaccgcataggggccaagcgaatccagaagggaataaacctaaacactaaccacctaactaacctagagattaccctaatctaatccatcctcaagaaccctaatcactactcatgcaacattctcaagaacacaaatccataaattactaaaatcataccaaaatgtagatctaaacaagctaaacaactttacttaaacaatcaaatgcaaaaacgaaatagattaagaataattaaggtttcaagattcataaaaacaaagaaaaactgaaagataaagcattgatattttggacaaaccccaaaatgatctatttatagtaaaatgttgaaaccctagattcactagaagacaagagacttgaagcgatttgggcaaatactcgatcttggggatcgagtaaagagggtgctgcaaagtctgcgcctttgtgtctatgctccgagtgatcaattggtcgagtagatgcttcatcctctcctatccgtatgcttagatgtctggttgagtggggaatgaggaggatccgaagacgctttgatagcccaacaagtcttgtagagatggtcaccctaggtcgagtaaatggatcgagtagtggatcgagttggaggggcgagtagatcaatctgctgcttcatctgaggttgccttgatcgagtaggagggtcgagtaaactgcagcctcctctgtggcatcctggatcgagtaaagaggtcaagtagaatgatgtctcttctgtagctgcctggatcgagtgaatggatctagtagagtccttttaagctccttttgcacctgaaaacacaccaaaacatgcaatgcggatgcaagatgatcctagatgcctaagtatgcaaaacaagctaaaatggtgcaaaatgatatgatacaatgagcaaatgcaaagctaaatgatgattaacatacacctaaaatgtgtaaaatacagtgttatcaacaatcaaaactccatctttctcgaaccatttcttttatctctccacctttaccttaattcttctccacttccgcaactaacctactccacgaccacaaaaataacatatccagcaccgtcgtcatctttgtctcaatctctcatgtgttaaatgtatttaaatttaaatttgtaggagtgaagaaaatgatgtatttaaatttgtatgacgtcattcattatagaaaataagacatcaaaagaagttctatgcaagttgaataacaaacgtgttaccaccagatcaagcaatatatttgtagaagtttgtaaaaatattgtatttatttattcttacatggaaagttaaaatttaatgtagtttactgattctaaaacgcctcgttaacggctgttaaggagagagatttgaatctactaacaatttaaaaataaagtttttaagacaaaaatatttaaatgaggtattttatcttctttggctttggctttggctttgtatcttctagcaaggaaacactactatagcttttgggatctggttgcggttctagttcttatactcattcatatacatgacatctagtcatatttgactccaaaacactatacgtgcttcttcttacttctcattgttttgatagtgtagccaaaatccgtatgaattttctgttttagatcttctaaaagggaaacactactttagcttttgggatccaattgcggttctagctctcatacttaatcatacacttgacatctactcatatttgactccaaaacactaaccaagcgttttcttgtttctccatgctgtgatggtgtagccgaagtccatatgagttttttgtttaagatcttctaacaaggaaacactatttaagctttttagatcccgttgttgttctagttcgtatactcaatcatacacgtgacatctagtcatatttgactccaaaacgctaacaaagcttcttattgtttttcaatgctttgatggtgtagccgaagtctgtatgagtttttagttttggatcttctaatatggaaacactactttaactttttggatctagttgcagttctagtcttatacttaatcatacacatgaaatctattcatatttgacgcctttagttctcaatgcttaatgagaagccctattcctaacaagcacactactcagacaaattgattgaagcaaacaacataattgagtatgaaagcttaaatacagcaataaagatgagggaaagaaaggatctcttcactgaattgaaactgaatgaatctctgaagaaaaggggatgaatagcttatgtctctcaaaatagggtttgtaaaaagcttgataaaaagaaaataggtctaaaacaatgtatataaacactataaatcgtccagggactaataatgcaaatagggaagttttctggagcaaatttcctcttctgtaaacttgaaagcgtcatggactttgtttggccgaagctagtgtcgatcgacaccaggagtgtgtcgattgacactcctcttgattcctgagtccaaaagcatcctcaacttccttttccttagcttttgctccaaaatgtctcctcatctccattgttgtcccattgcatggaatacctgaaaaaacactaaaaagactcgagaaataacataaagactcaaaaacctatatctaaaacatagataaaatcattgaaaatagggttctatcaaagatccaaaaccaaaaactctaacggacttttgctacaccatcatagcattgagaagcaaataagctttggtagtgttttggagtcaaatatgactagatctcatgtgtaagattgaatataagaactagaccgacaaacggatattgaatacttaagtaatgattgcttgttagaagatacaaacccaaagactcacacaaactctggctacaccctcaaagctttgagaagcaagaagaagcttggttagtgttttggagtcaaatataactagatgtcatgtgtatgattaagtataagaactagaagcgcaacgtgataccaaaagctaaagtagtgtttcattataagatgatccaaaaacaaaaaatcatacagacttcgactacaccatcaacgtattgataagcaagaataagcttggttagtgttttggagtcacatatgactagatctaatgtgtatgattgagtataagaactagaaccgcaaccagatcttgaaagattaaaagattaagtagtgattccttgttagaaaataaaaacccaaagactcatatggacttcggctacaccatcaaagctttgagaagcaagaagaagttgttgacgagctaattggaagaagcggacctgaaaatgttaaaccactcgaccccctggtcgagtagatgcttcactacttcaacagaccacttgaccccgtggtcgagtaaaagacctcagcactccacgtcaccactcgaccacgtggtcgagtaccaccaggacaaccactcgatcacatcactagaccccctggtcgagtatcatcatgcccaccacatcaccttcactcaatcactctaccaacaggtcgagtatcactattatcatacactcgaccaatcacactaccaacatggtcgagtatcaccatcatcattcacttgaccaatcactctaccaacaggtcgagtatcatcatcatcactcactcgaccaatcactctaccaacaggtcgagtatcaccatcatcattcactcgaccaatcactctaccaacatggccgagttccaccattatcattcactcgaccaatcactctaccaccaagtcgagtactaccaccaccatccactcgaccaatcactctaccacatggtcgagtcccttatcatcattcactcgacgtctttactcgactgccagcttcagagtcttctccattccgcactcaaccagacactcgagcacaaggaagaaaagaagactttagcttatcactcgaccactcactcgaccacctgggtcgagtactgttcttaatccgtcctaatactgcgtcgttttgagtattagggtttgagaaatatttcgctataagtagcatgcacttaacattttcgacaagaagttttttatctagttttatttccgcagacttagatttggttaatgaacttgttatctagggttaatttattgagcatgccaatcacctgtaaactgaggaaacgaaactactcaattaccccatccttgggaattctttatctgattgaattctttgtttactctactaatgtttactacatcttgtcatctgttgcttagtttctgcaattctttactgttactcgacctaatactcgaccacccagttgtctggcaacacactgtgcagtcgagtatccctgttatactttctgtctgttactcgacctatcactcgacctcacccagtcctctgcaaagagctgtgttggtcgagtgttttattgtttttgcttgaatttctgttttctgcatgttcacttagaacttctagaacacaccaagacctgttattgcttggcttgacttagtgacttctgatcacatcttgattgttagcctcacacccatttggattgacaaccttcagtactacaacgacatgatagtgttttaggattaattgattttaaaaacctattatcacttctaacaaggaaacactacttaggcttttaagatcgggttgcggtttaagtttttatactcaatcatacacatgacatcaagtcatattcgactccaaaacactaaccaagcttcttcttgcttctcaaagctttcatggtgtagccaaagtccgtatgagtctttggctttgtgtcttctaacaaggatacaattcttacggctttaagatccgattgcggtttaagttcttatactcaatcatacacatgacatcaagtcatattctactccaaaacactaaccaagcctcttctagcttctccaagctttcatggagtagccaaagtccgtacgagtctttggctttgtatcttctaacaaggaaacactacttaggcttttaagatcgggttgcggtttaagtttttatactcaatcatacacatgacataaagtcatattcgattccaaaacactaaccaagcttcttctagcttctcaaagctttcatggtgtagccaaagtccgtatgagtctttggctttgtatcttctaacaaggaaacactacttaggcttttaagatcgagttgcggtttaagttcttatactcaatcatacacattacatcaagtcatatttgactccaaaacactaactaagcctcttctagcttctccaagctttcatggtttagccaaattctgtatgagtttttggcattgtatcttctaacaaggaaacactacgtaggcttttaagattgggttgcggtttaagttcttatacttaatcatacacatgacatatagtcatatttgacttcaaaacactaaccaagcttcttctagcttctcaaagctttcatggtgtagccaaagtccgtatgagtctttggctttgtatcttctaacaaggaaacactactaaggcttttaagatcgggttgcgatttaagtttttatactcaatcatacacatgacatcaagtcatattcgactccaaaacactaaccaaccttcttcttgcttctcaaagctttcatggtgtagccaaagtccgtatgagtctttggctttgtgtcttctaacaaggatacaattcttaccgctttaagataccattatggtttaagttcttatactcaatcatacacatgacatctagtcatattctactccaaaacactaaccaagcttcttctagcttctcaaagctttcatggtgtagccaaagtccgtatgactctttggctttgtatcttctaacaaggaaacactacttaggcttttaagatcgagttgcggtgtaagttcttataatcaatcatacacatgacctcaagtcatattcgactccaaaacactaaccaagcctcttctagcttttccaagctttcatggtgtagccaaagtccgtatgagtctttggctttgtatcttctaacaaggaaacactacttaggcttttaagatcgggttgcggtttaagttcttatactcaatcatacacatgacataaagtcatattcgactccaaaacactaaccaagcttcttctagcttctcaaagctttcatggtgtagccaaagtccgtatgagtctttggctttgtatcttctaacaaggaaacactacttaggcttttaagatcgagttgcggtttaagttcttatactcaatcatacacattacatcaagtcatatttgactccaaaacactaactaagcctcttctagcttctccaagctttcatggtttagccaaattctgtatgagtttttggcattgtatcttctaacaaggaaacactacgtaggcttttaagattgggttgcggtttaagttcttatacttaatcatacacatgacatatagtcatatttgactccaaaacactaaccaagcttcttctagcttctcaaagctttcattgtgtagccaaagtccgtatgagtctttggctttgtatcttctaacaaggaaacactactaaggcttttaagatcgggttgcgatttaagtttttatactcaatcatacacatgacatcaagtcatattcgactccaaaacactaaccaaccttcttcttgcttctcaaagctttcatggtgtagccaaagtccgtatgagtctttggctttgtgtcttctaacaaggatacaattcttaccgctttaagataccattatggtttaagttcttatactcaatcatacacatgacatctagtcatattctactccaaaacactaaccaagctt

SEQ ID NO: 210 - DNA, 50959 bp, Arabidopsis thaliana
aagcttcagatgaagttgaatcttgccaagtagacattctgagtcccatccggagagtttctcggttacttagcaacaaagagagaaaccgaagcaaacccaagacagattaacgctcttttcgaacatgctagccccaaggaacatcaaagatgtctaaagactctttggtaggattactgcgttaaaccggttaacatctcagtcagccgataaatgcctttctttctatcaaatactaaaagggaacaaagagttgagttggatgaaagatgtgaagatgctttcggtcaactaaagacatacttaagtgttgctctaattctctgaagcctgaagccgatgaaaaattgtacttatacatctcattttcaaatcatgccgttaatggagtaataatttctgaagacagaagagagtgaaagccgatttgttacatgagcaagtcatcaaccagtccaaaattaagttacactataatggagaaacttgcgattgatgtagtcacttcaacttggaagctgcgactttatctatgtctcaccagatcatagttgaaactcttgggaatattggttaatttcggcggggttcaagtgtccaattcgctcttcacgaaactagatctcatcccaagaaggtttttccaagtttcaactcttggaaaaataagattattttggtggactataagtgttgagttcgctcttcactgaactatctcgtgaagggtttttccaagttccaactcttggaaaaataaatctctgtgaaatctaagtgttgagatcgctcttcacaaatttagataccacctcacatcaacaagcatttatgacgaagtctttgagtacaagctcggaagaagatcttcagtttctctctagattgctgctcaataacctgcctttgtattctataagcagaatacactttctaaactcaagcttatagcttcgattcgaaagtcgagttcacttcgcaacaacttaactcgaggtcagctcccatgcataactcgagtttaattctgataccaaaactccatggttgaactgacgagtttgagtcaataaaatggatttaatcctcttggacaaggggtcaactagcaaaacaaagatctttacggtgtttagtcgatctacctaatacttcttaggcggagcacaattctcgcaatcaaagaaagtccaaagattgagtttgggggtttgatcaacctatttctctcttagccacatggcccaaatttctcttagccacatggcccaaatttttgaaaaagtacggactttgcaaatccggcaacttcgaagcaaatactttaagcaagtgtcattccaaaacccctatggacaacgaaaaggaaaaaagttttaaaaacccctcttgggcacacaaccaacaaattttaaaaccccttgggcaaataaaaattccctttcgggaaagtcgtattcataaaataaattgggacaatccccagattttatggtaatagccataaaagagttaagatgagctgaagcctcatcaacactcggtgtaatctcgtcttggttcaaagcaggagtggccgtcccttgatcgtgagtttcagtttcataattaggagctgcacatgagctggatgaagcatgagcattagttaggatacacattttggcgagttgtcattcaagtgtatgaattgattgtgaaagttattttatgaattagttctataattaatggcacattggaagaaggaaagaggctataaaagagaggtgatgactccaagataaggggggctagagattctatattctgaccacaaatcttaaacttaaacattgttattttctcataaatacacaaaagattatttcttctctttttatgtaagatctttacataaggaatactataccattttctatgtacaattcttcatacatttctatatactctcttatacttttcttatgcatatatgtcgtgtacttttgtatttgagagctttagcccacaaataatataaatacttgagtgtgtgaatccgacatccataaaagtctgtatgagtatctggctatgtatcttctagcatggaaacacaactttagcttttaggatctggttgtgcttctacttcttatagtcaatcatagacatgacatctagtcatatttgactccaaaacactaaacaagcttcttcttgcttctcaaagctttgatagtgacgtcgaagtccgtatgagtctttggctttgtatcttctaacaaggaaacaataattaaggtttcaagatccggttgcggttctagttcttatactcaatcatacacatgacatatagtcatatttaactccaaaacactaactaagcttctttttgcttctcaaatctttgatggtgaagacaaagtccgtatgagtctttggctttctatcttcaaacaaggaaacactacttaggctttcaagatccggttgcgattctagttcttatactcaatcatacacatgacgtctagtcatatctgacccctaaacactaaccaagcttcttcgtgcttctcacagctttgatggtgtcgtcgaagtccgtatgagtctttggatttgtatcttctaacaaggaaacattacataggattttaagattagtttgcggttctagttcttatactggatcataaccatgacatctaaacaaatttgagtccaaaacactaaccaagcttcttcttacttcccaaagctttgatggtgtagcccaagtccgtatgagtctttggctttgtatctctactaataaggagactctacttaggcttctaagatctcgttgaggttctagttcttatactcaatcatacacatgacatctagtcatatttgactccaaaacactaatcaagcttcttcttgcttttcaaagatttgatactgaagctgaagtctatatgagtttttggctttgtatcttttaacaaggaaacagtacttaggctttcaagatccagttattgttctagttcttttgctcacccatacacatgaaatctagtcatatttgactccataacactaaccaaacttattcttgcttctcaaagctttgatggtgtagccaaagtccagataagtctttggctttgtatcttctaacaaggaaacaatacttaggctttcaagatctggttgcggttatagttcttatacttaatcatacacatgacatattgtcatatttcagtccgaaacactaactaagcttttttttgcttctcaacactttgatggtgaaaccgaagtccgtatgagtctttgggtttctatcttgtaataaggaaacattatttaggctttcaagatccggttgcgattctagttctgatactcaatcatacacatgacatctattcatacttgactccaaaacactaaccaagcttctttttacttctcaaagctttgatggtgtagctgaagtccgtatgattctttggctttgtatcttttaacaacgaaacattacttaggcttttaagatcctgttacggttctagttattatactgaatcatacacatgacctcttgtcatatttcactccaaatcactaagtaatcttcttattgcttctcaaagctttgatggtgtagccgaagtctttatgagtctttggatttgtatcttctaacaaggaaacactacttaggcttttaagatccagttgtggtgctagttcttatacacaatcatacacatgacatctagtcatatttcattccaaaacactaaacaagcttcttcttgcttctcaaagctttgatggtatagtcgaaatccgtatgagtctttggatttgtatcttctaacaaggaaacagctcttaggcttttaagattcggttgcggttctagttcttatactcaatcatacacatgatatctaatcatatttgactccaaaacactaaccaagcttcctcttgcttctgaaagttttgatggtgtaggtgaagtccgtatgagtgtttggttttgtatcttctaacaaggaaacacaacttaggcttttaagatctgattgcggttctagttcttatactcaatcatagacatgacatctagtcatatttgactgcaaaacaataaccaagctacttcttgcttctcatagttttgatggtgtagccatagtccgtatgagtgtttggttttgtatcttctagcatggaaacaaaaccttagcttttaggatctagttgtggttctagttcttataatcaatcatacacatgacatctagtcatatttgactctaaaagactaacaagcttcttcttgcttttcaaagctttgatggtgaagccaaagtccgtatgagtctttggctttgtatcttctaacaaggaaacaatatttaggctttcaagatccggttgcggttctagttcttagacttaatcatagacatgacatatagtcatatttatctccaaaacactaactaagctttattttgcttctcaaaactttgatggtgaagccgaagtccgtatgagtcttttgctttctatcttctaacaagaaaacactacttaggcttttaagatcgggttgtggtttaagttgttatactcaatcatacacatgacatcaagtcatatatgactccaaaacactaaccaagcttctttgtgcttctcaaacctttgatggggtagtcgaagtccttatgactctttggatttttatcttctaacatggaaacatcacataggattttaagattactttgtagttctagttcttatactcaatcatacacatgacatctagtcatatttgactccaaaacactaacccagcttcttcttatttctcaaagctttgatagtggagttgaagtccgtatgagtctttggctttgtatctttgacaaggaaacactacataggcttttaagatcctgttgcggttctagttcttatactcaatcatacacatgacctcttgtcatatttgactccaaaacactacccaagcttcttcttgcttctcaaagctttgatagtgtagctgaagtccgtatgagtatttggctttgtatattctaacaaggaaacattacttaggcttttaagatccagttattgttctagttcttttacttaatcatacacatgaaacctagtcatatttgactccaaaacactaacaaaagttcttcttgcttctcaaagctttgatggtgtaggcaaagtccgtatgagtctttggctttgtatcttctaacaaggaaacactacttaggctttcaagatcgggttgcggttctagttctcatactcattcatacacatgacatctactcatatttaactctaaaacactaaccaagcttcttcttgcttcccaaagcttcgatgatgtagccgaagtccgtatgagtctttggctttataccttctagcatggaaacacaactttagcttttgggatccagttgttgttctagttcttatacgcaatcaaatacatgatatctagtcatatttgactccaaaactctaaccaatattcttcttgcttctcaaatctttgatggtgtatccgaaatccgtatgagtctttggctttgtatcttctaacaaggaaacactacttagcttttaagatctggttgcggttctagttccgatactcaatcatacacatgatatcaagtcatattcaactccaaaacactaaccaagcttcttcttgcttctcaaagctttgatggtgtagccaaagtccgtatgagtctttggctttgtatcttctaacaaggtaacactacttaggcttttaagatcaggttgcagtttaagttcttatactcaatcatacacatgacatcatgacatcaagtcatattcgactccaaaacactaaccaagcctcttcttgcttctcaaagctttgatggtgaagccaaagttcgtataaatatttggctttgtatcttcgaacaaggaaacactctttaggctattaagatcagttgcggttctagttcttatactcaatcatacacatgacatctagtcatatttgactccaaatcactaaccaagcttcttcttgcttctcaaagctttgatggtgtagccgaaatccgtatgagtctttggctttgtatcttctaacaagaaaacactacttaggctttcaagatccggttgtggttctagttcttatactcaatcatacacatgacatctagtcatatttgactccaaatcactaaccaagcttcttcttgcttctcgaggctttgatggtgaagctgaagtccgtatgagtctttgcctttgtatctttgatgtaggtcaaattgccttaagcccactctttcaaataagagaacgattgtagcactgaagggtcgaattccacaaagctctcggatcacacaatagaccaaggttttgaatctacatatacatttttggtagggtttttggccaaaaatctttcacctatttactatttgcaatatgagtccttacaaatttaatctcaatcaaatactttataactaaaaacttacaattagtttaattgcattaattagttgaattaactctttcctaaatttttattctcaattaaatcatttttattgaactatattcgattaaggctaatttcctaaaatatatatatcgacattaaatttaaatatctaatttttttgtcactatatttgtttatatatatatataattttgcttttagtttatatataaaacacatatagttaataaaatattagattttttttgcatctgatgaaattcaaattttttcaaacaaacatataatactccatcgatgaaaaaaaaagttttaaagcgactaatagtgagttatgaataaaaagcgactaaatccggtaatcgtaaatcgatgctaaaataaatagtcgtaaaaatagtcgccaaatagcgaatattgtacgactaatattcatagtcgtaagagtagtcataaaatagtcgtcaaatttagtgactaattgactaatctgcgattaaatttcacgaacataaattgtttgtagtgttatagtagtagagtagtcattaaaaattcgttaaaatttagtgactaatttacaactatattgcgactatggtcgtatttatgtacaagaataccatattacaaaataaaattacaaacattataaaaaataagaatacatcatcctcctaaaaacataactaaaacaaagtagataacaatctttaagaaagaacttggttaaattaattcttttgatctcaatttttcctccttgtcttacatctttcatgttttcttcttctccaaaaactgcctcatggttatttctaccagaagaaaatgctgatatgctatcataggtctggtcaagatcatctccttgcaaacagaacacaccatgagaaggcaaggacataacatcttaagacgaacctatcaacatgattctggccaagcattaaatcatgatttgccattgcagaaacaatagcacactgcttaaaaaacaaacaccgttaaaaagacaagtagttctcacactatagcaataaaagaacagtacatgtaacaagagaacatatcaacaagttctatttatccaactatagaacacaaacccacataagaccaaagcatgagagactatatcaatgtgagcttaaattaaaaaaaaaagtaaagaacttggcgagataagccaaacagttcttaaggcacaatcatcattttcgcaacttaatatcttcggacctcacagttaagaacttgaatagctacactatcataagaaacatatgtaaatttcttggtcagacaatataggcaacttggtttttaaaagatcagttcaattgatctcagctgttaaatagtttatcactctatagctaatacattaagaatgtttagagaaagataaacacagatttgactttgtagtgatcactaacctgaattggtcccttttttttatgttttctctatgaaacaaggtttgacaaaaattaacaccccattacttttttagaaaaacaaacttcgacaatatccaatcacaatgatagctttgaaaccagaaattatagacatatcaagctaaaatgatcagctcttctaattatattcaaagagaagtggatcaacatgagaaaaagccattatcaaagttcagaaatcaaaactcgtaaaagacaagacaccattgattatcagatctttaaatttaaaagcaaaaaccatgacccgttactttgtccaaagtctaagtacattcaaactatgagagaaagtaaactcgtaccttaaacccaactgaaactgttgggacttttttaaaacatctcttaggctgcgctggaagaggtccatccctagtctacaagagaaatcgagacaaagtaagcaaatatcaaaacttaccaatccaagcagtagcaacagatgctaaagaagttccaactgcatacacgaccatgtgcctctcgaacaagtcctaagtgattaaatatattagcgagatatgcgggcagtttggaacaagaagttgttaagattgttccacaagtttttgatagttgtagatttgattttttcggatcctcttagagattcttttgtaatctatttaaagcattgtaaacacttctcttgaatatatcagaaaactgaacatattttcccagtcacaatctctgaattcgcatagtaacagagcctttctcttaaaatttttgattggaaaatagagaagtgattctctacgacgatggcagcgatgaacccatcaacgaacccgacgaccactgaagtccgacgaaccatatccccctacgacaaccccggtgctgtgatttcccacccgttgctgcaagcaacaaactacgatgagtgggtctgtagcatgaaaactgcattgtgctctcgaaagaaatttggatttctcgacggctcaattgcacgacctgcagaaaactctcccgatttggaggattggtggaccattcaagcgttacttgtctcttggataaagatgtctattgatccaagtctccgatctaacgtctcacaccgtgatgttgcgaaggatctgtgggaccatctaaagaaacgattctctgtcactaatggactgagaattcaacagatcaaagccgagctagcatgctgcaaacaaaggggtctagccattgagacctactttggaaagctaactcgcatttgggacagtatggcgaactatcgtcctttgagagtttgcaagtgtcgtaagtgtgagtgtgatcttggcacacttcaagagaaggacattgaagaagacaaggtacatcaattcctttttgggctggacgatacacatttccgaacagtgaggtcaagcttggttttgagagttccgatccaatctatggaggaagaatataatatggtacgacaagaggaagatatggtaagaaatggaatcaaaggcgttgaatagagctcagaagtaaacgcatttgctgtccacaccactacaccatttcaaagagatgagagagataagtcagtgttttgcaaactctgcaacagagcgggtcattctagcgacagctgctatggcgtgataggctatccagagtggtggggagatagaccgagatctcgctctacgtctagctgtggtcgtggacgtggaggctcaaacagaggggctggaaagagtcgtggcagcacctcgtacgtcaacgccgtcggagttaatgaaccaacaggttatgcagccgctaactacgtcatcaccgacaatgacagagatggagtgaccggtttctccgattcacagtggaaggtgattaagaatctgctcaatgctaacactagcaaagtctatgaatccgaaaaactgacgggtacgtactcttttccctcttggataatggatacaggggctacacatcacttgacgggtcagttagaaatcttaacggatgttaaagatattcaaccagttggaattgtgttagctgatgggagacaacgagtgtcagttaaagaaggatcagtgaggcttgggccgaattggacactaaaatcagtttattatgttgatgggtttcaatcaaatttgatttctctttgtcaattgatggatgaaaatcgttgcgtagtgcagttagctgatcatttccttgttgttcaggaccgcactacgaggacggtgattggagttagtaagcaaaagggagggaccttccttttttggagtttggagtctgtaacatctgttgaagttagagatgagaagtcattcgagttgtggcatcaacggatgggacatccttcagctaaagtagttggtcttcttcctttaatctcaaatgttatttcttctgaaattttgaataaagcatgcgatatatgtctccgcgctaagcaaacccggttgtcttttccaataagtgagaataaaacgaaaaggatttttgatcttattcactgtgatttatggggtccatatcgaactccaacacactctggtgctcgttatttcttaactatcgttgatgattactctcgaggagtgtggttatatttgcttaacgaaaaatctgaggcaccaaatgttttgaagaacttcatagccatgactgaacgacaattcgaaacccaagtttaagtcataagaagtgataacggctctgaatttgttagtttgaatgagttcttcaagaaacaagagattgttcatgagacatcatgcgtcggcactcctcagcagaatggacgggttgaaagaaagcacagacatattctaaacgtggccagagctctacagtttcaagctaacttgcccattgagttttgggggaatgtgttctcagagcggcatatttaatcaatcgaacaccgagtatggtctggaaaggaatgactccttatgaacggatatacaatgctaaaccggtgtatgatcacattcgaattcttgggaacacgtgctatgctcacgaccaatcacatggaggcgataagttcgcatcgcgaagccgtcgatgtgtattcatgggatatccgtacgggaaaaaggggtggcagttatatgatctagagaagtgtcaattctttgtctcaagagatgtggtgttctttgaacatgaatttccatttaaatcggatgttgcagaagaatttgtggaagaagctgaaaattttaacatagcttctttgtacgtcgaggaagaagaaacagagagaagattgggccagttgggccaacttaatgctgaaagcccacttgttacaactaattcagatgggctgcccataagcccaattcgaaataatgaagaagctattattagtgaaaatcaaaacgacgttgcagttgaaacttcacgtcacgttcctcttcgtaacttgccatcatcttcttcctcagagattccacgatcgacgacgtcacgacctccaccattaacatcaccgcaagtacaaacaaagaaatcgtttcctactgaacaattgggtcgaggaaagaggcagagaacacattcagtaaaattgaaggaattcgtgattgagactggaaatccaaaaacaaagaagaacaagtccacatctgagtatctgattgccaattacgttgactgtgagcgtttctctgagtcacataaagcatacatggttgcaattactcagggcgtagaggcaaaatcgtttaaaaaggcaatggaagacgatagattgaaaggggcaatgggttcataaattgattctcaggaaagaaatcattcgttgaccatagaggatttgcctaaagggaaaaaggcaataggatgtaaatgggtttacaagatcaaatacaagtctgatggcaccttggagagacataaagccaaactggttgctcttggaaacaaacaagttgaaggagtagactatggataaacttttgcgccggtagctaaaatgggaaccgtgagattgttcttagatacggcagttaagaacaagtgggatgttcaccagaaggacgtctacaatgtgtttcttcacggcgaccttgaagaagaaatttatatgaagctaccatcagggtttaaagcaaccgatccgaacaaggtatgcagacttcgaaagtctatttatggattgaagcagagtccgaggtcctggtttgccaaattgtctacggcgttaaaaaatttgaatttgagcaaaatctctctgattattcattgttcaccaaggatgcaaatggagagtcacttcacgttttagtgtatgtcgacgatctcacttaaggtcatgaatgattttaaagattacttgttgtcgtgctttcacatgaaggacttaggccaattaaaatacttcctgggaattgaagtagcaagaaactctaccggtatgtatctttgttaaagaaagtacgcattggacattatctcagatgttggactacttggtgcgaaacctgtagcgtttcctttggaaacaaacaatgacttgtcattgtcgaagtccgcgtttttaaacaaccctgaaccttatagaagattggtgggtagattgatatacttggctgtgactcgacccgatttagcgttctcttttcactttcttgctctgtttatgcaaaagccgagagaagatcattggggagcagccttgcgggtggttcgatatttgaaaaacaatcctggtcaggggatattgttacgagcagacacaccttttcaattgtccggatggtgtgatagtgactacgcaagctgcaggctatcaagaaaatccgtaactggatacttcatatagctgggagggtcacctatctcatggaagacgaaaaagcaaaagacagtgagtagatcctcggaagaagcagaataccgagcattggcatatttgactcaagaattgatttggttaaaaacaattctttcagcgctcggagtcaaacacaatcaaccgatgaatgttcgctgcgatagcaaagccgccattcatatcgcaacaaacccagtgtttcatgagcgcacaaaacatgtggaggtcgattgccactttgtccgagaagaggtgataactaaaaacatttgtctcctacatgtcaagagtgagtctcagcttgctgatatttttactaaaccattgggaagacaagagttttatcgtttttgtttcaagttgggcattacagacctccatgctccaacttgagggagggtattagcgagatatgcaggcagtttggaacaagaagttgttaaggttgttccacaagttttttatagttgtagatttgattttatcggatcctcttaaagattcttttgtaatctatttaaagcattgtaaacacttctcttgaatatatcagaaaactgaacatattttcccagtcacgatctctgaattcacaaaataaaactccatttaagcaactatacccaaaatttataacataactcctgattcgcaaaacattcccaatcccaattcttcaaaatacgatataaattggaaaatttgaagtaaaagacgcattcaatacatactcgtctccataccaaccaacacatgcgattcaaaactcccatttaaacccaatcactgagagaaaagttttaaaatttagagattacaaaagggtggccacttaagagaaaaaagttaagatttagagagcgtacccaatcaaacatccctcctctgatgttggtgatggccaaatcctttacattcccttttcaaaacggaagagggcgctaacaagaggattgacgaacaagcttgagatcgagaatctccttgacttgaaccaataagattgcaactccgcaggacgaatcgaacatcaacaacagagaaaaccgatctctgtccttaagaggctagatctgggaacacgaatcaagtgagataaactcagatcgacccaaaggggatcaataaattggagcgccatcatccttaaacatgagctaaggagatgtcttgagctgctgctaatcgagatctcaaatcaggaactctatatccctgctaatcaccgctaaaacaacagatgatggattaaataactccaaagacacaaacgaagaagctgctaggttcaaatccccaacaaagaacataacattgtttagaagtgaaagattgagaagagaagaagcgatagaaatagagagagatttgatagtgtatttcattgataagcaaccctaaatttgagaatccgcttaagtctctgagttgcaatagtaaacgacaacgtattcaatgtaaaagagaaaggacaaaccctctttctcaattagaggtttactaatacttcaaacgaattttcataagttcgttttcagtacaagaagaatctttttcattgcacaaaaaaaagaagaatcttcttcttgcttcatgtatatattctaaagtagccacaaagatttagaacattttattgtctattattgtttcgcccaaattttagttctgacaatttaatagggagatgaaaaaaaattagatgccaattaaaatttttatgatttaatttttaagttgagcacaaagttaaaactttagaatttataatatagggttttggatttaaaatcagaaatttggaattagaattctaattttaaatataataattgaattttttttagggatttcaatttataagtataaaacgaattaaaaaaacaatggtaaagtaaatatgtaaataaatataaatgtttcttttatgtatatataatgattatgttttggtttatgaattaatttctgtgattcagtgcttaatcaaacccgagccatgtttgtagtaggtgacggtcgttgccgtcttcttcgttccaaaatgttggacacactctttcgccggttgagtcgccattgttaggattttatgatttccgtgctttttctgcagccaaggagattatatgagtagagaaaaaaaacataatgcgttaagcttttataggtcaacgtgatgatggactgactttgaaggcccataaattagggtaactatgacctgttacaatgtttatgggtacataacttagattaaccgactacatcttctaataaaccaacgggtttcgtcaatttcgaagattcgcaaaaaacggatgtatgtggtcaaccactagatttagatttcaaagatgtgttttttttgtaccattttcgctaggaacttgtaagtatgcgagctaaacgacaacttatggttaaaatgatcggttatatctttcatgttttttgatcaaatgagtttctaattttgttaccaaaaattttggtttttgattgatattcggtttatatgcggttaaatcggattgattgctgacaaccaaaaataaatcagatcggttagatttaatataattaacaaacaaacaaaaaaacaaaataggccatttgtgaaacaaaacccaaataaaaattgggcattttttaatacaactcaaacaaagttgggcctttttgcttagagaaacaaaatcaaggcctcttaatttttatttatttatttatttcagatctacatatatgtgtgtaccttcttctttgcgagacatgttaataaagtgaggcttacagttccagggtaaaaagttttagaaatgttccgggcagcttcagcgattcgatttacatttgttgtggtatttaaaattgattttggtttggtttacattggtttagagaatgaaaacagaaaaacaaaaaacttgtgcgatgtgtttttgagagagaagtgcgtcgattgaaaaaggcatgatttcgaaaggggtacacccatagaattgctctaactcgctcaacgcgcacttggtgagagggggtgtgaaatagagccttctgattgggtgaaaaaatctaagaaattgaaatagtagacatgttgctagctcctcttctatgttatttaaaaagtcaattttaaagtttgcattcaaatggttctcataatataaatacatatatatatttatatatatgtatatgttttaaagagtttatctacactattaaaataagaaacatttaaagagttaatgatatttttcgttgcaaaattgataatataattttattaaaaacattattatttttattatgaatttagtttagttgctaataattttatatttacataatatataaaggaaaaaacaaataagatcttgtatctctaaacatatttcgatttgaaaaaaaaaaaatattggatagaatgtatgtcgcatatttgttttggctatgtacttaatctgttatagtttgtaaatgagaaaatatcggaatatatttataacataattattattacttagtttttattattaaaatattttgtatttttcaattaatggcatttgatttatgttgattgttttttgttttatctataataaattgaaaaatacaaaatagttcgatttatattcgaaataaatatattgatgctgaatatttagttatttaatatttgatgttttgtttagtagacaaatcatagtaaaaatagtgacgaagcaaatctcggaatatattggatcatttaatcaggttatttgtttttgcaaaaaattaataaaggatccaaatcaaaaatatttatttagttgtattagttgttaatttatcaggttatttatttatttgtcaaagatatcctcacagttgtagttcacaaaatgtttttcagttaatagtatagattttgtgataaagaatcattagagagataagcatggccctatcttcaatgatttttgttcatacatgtcttttcaatatgataaatatcttaagaatctcccttttaattatctaactaggtcacccgtgggcatctgttacatctcaattctgtgtatttcacaaagaatctactatattttctttatctgtaaacatgttgtatatttagtcttgtcaaaccatattttgtttagtaaatatagttttcttggtttgcagtataaaaaatatatgtctacagttggtatgtacgttttggaacgtaattgtatatttagtatatgtaggtgtacacatagtatttgtacagtttcgtgtatgtcattaacatgtaagctaattataaaatttgataatttaatacttggaaaatgtctttcttcaaacttcaaactcataattaaaaaaaaaaaagaatattaataaacttctccactagtattaaaaaaagcttgcattaagaaaatgggaaaacgaaaagctttttaataattattccaacctgcaaatttaaaaacgactaaattagcatgttatataattttgcaaaatgatatttattttataataatcaaactaaataaatcctgtagaaataatctactaaaggttttgaaatatttctttgaaaacaacatttgctgtttctttcttctgtattccttaccttctgtaataagaaccttcagccctgcctttgatttcactctagacatagcgacatacaactgtccatgtgagaaaacaggcttcgacaaatatatgccaacattggctaatgactggccttggctcttattgatcgtcactgcaaatgtaacagataaaggaaactgccttcgtcgcattttaatgggcaatctacgatccaaaggaattaggggcatcctgggaataaggaccggtttaccaactctagtaccttctaatatacgtccttgcaccggtttatctccaagtctgatgacatagctcaaattgccttaagcttactccctcaaataagagatcgtcgttagcacttaagggtcgaattccactgatctctcgatgttcaaacaatagacttatggtgttattaaataagctagacaaagtaattgaatgtaaaagacaaataagcaagtaaacgaagtgtagatttaagtgattaaagcgtcaggtctaaggaattatctcgggagatagataaagtgtagatctagctaatataaggattgttatcgcactgttctcgaactcaaactatgattctaaagtaaccggtggtgttccgcaaaactctctatacttagagctaagataactgaagaagccgagaaatcctatactcaaaacatacgaaaaagattagaaagactctaaaaaccattctgaaactatgttagaaatcaataaaaaaaccaggacatatcaacttccccagagtaagcctttgcttgccctcaagtgataacactgtattttactcatttttggtgtgtgtttatcatcatttagctttgcatttgctcattgtatcatatcattttgcaccattttagcttattttgcacacttaggcatttaggatcatcttgcatacatattgcatgttttggtgtgttttaaggtgcagaaggagcttaaaagcattctactcaatccattcactcgatccaggcagccatagaggaggcagcaattcactcgaccctcttactcgatcaaggcaacctcagaagaagcagcagatcaatctactcgccccttctactcgatcctctattcgactcatttactcgaccaagggttaccaactctacaagacttgttgatctatcaaagcgtcttcttatcatcctcattccctactcaaccagacatttgagcatacggataggagaggaagaagcatctactcgaccaattgatcactcggagcatagactcaaaggcgcaaactttgcagcaccctctttactcgatccccaagatcgagcactcgcccaaaccgcctcaagtctcttgtcttctagtgaatatagggttttcaacatttcactataaatagatcactttgggatttgtccaaaggatctagcttttatcctttagtttttctttgtgttcttgaatcttcaaaacttaattactcttaatctattttgtttttgcacttagttcttttagtaatgttgtgtagcttgtttagatcttccttttttatatgattttagtaatttctgggtttatgttcttagttatgttgcttgagtagtgattagggttcttgaggatggactagattagggcaatctctaggttagtcaggtggttaagattaggttagatcctttctggattcgcttggcccctatgcggtattcgctggctagtgtggagattcgatcatagacgtccaacgtccaaaagacgttcaaatggatatctgatttatgaattccagagatttgtaaacttgaccaagacattggcttgtcttcttattggctttggtagattgttgcttaaactctgctctattatgtttcataaacgatagttgagattaggaagtggtagagttatgggggtctctgtcacgacagtggattgacccggtttttgaatctattcgtctagggtatctacctttcacctgttagccacctgatgaatcctagagttgcccttatcaattaatccatccttaggacttctattcttcttagatttatttgtattcaccacctgattgcacttttatttacctgttatttgtatcccatgttgtttgcattttagttcttaatattgtcacctgttggttctactcgacccaatgattgagtagggctcttaagttctcatttttacctgtttgaaccctgacctaggattgttactagaaacccaccatcattataatctggcttgacttaattgcttctgtatacatcttgattgttaacaataatagtggactggattgacaccccctatagctgcatcgacatgtcagtgtttaagggaaattgaactgaacctcacattcaacacataagtaggcgtaaaaacctacttatcaacaagcaaaacaaaagattgaatctatgaaagaggtttgaaaaacatacaaaactcccaatctctctagcttatttccttgattatacaaaccaaacacatgcactaaacagttctaatcagatcctgaccaccatgtaattctttgctagcccacacaacatcctagattccataccaaagcactcaactatatccactaggctatcatcgctgggtctcatcaatcaagttaatgtttaagaaccttctagactcattcctgtattataccatgacaaatcgaccattcattttcttcttctttttttggtattctttctctcccctacacttattcttttaagagaggaaacaaagggtaactcgcatactggattgacaccctcggcatttttccaacctttgtaattgatcattccaaataatgtataataatggggtcataaaaaacattcctaaccttatacactattcgaaaattctatcaatctctcatatttttattatatatttttttataaggggagaggaatactttcttttatcacattagccgacttatcaggtatgaacaagcagtcaagtcctatgaacactaaccgttttgatgaggtaaaaggaagagcagtgagattagctccagcctctatggattatgttgggaatggatgtccttaagtttgttgattggctttctggattttccattagtcgaattgatttgaatctacagtacttaaacaatccaggcaataaactcgagagatagatcataatttcagacaaaagttttaactcaataaacgactatctaagttagaatgacacaactgactcataagaagagaaaagatgaagttagtaactgactcccctagacatagataacactgtccccaaagttattaagctagaggaatcgaaagaaaaataatcaaaagttaaaagttagagaaacgtgagttgccacctgagagtggtgtcgatcgattctaggttggtgtcgatcgacactcaggtcatttttgcatcgctttgcgaattcagctaatcgttgtagagctttggttagtgttttcacatggatcctccagttagactgttaaatcactaaaacacacatcaatagttccaatacaaataacaaatagtctgaaaataaagcaaaaacaaaatcagaaaacaaagcaagatagggaggatggctagtcctcatgctccgagccggaggtgggtgcgggagagcgacgacagtgacgagtggaagcaacacaaccgcgacgagagagtgtagctatggcgttccagacgctcttgaagctgtcgacgatgtactgatgaaagacctattgctctatcgggataggaggaggagaaggcagctcatatggtagacctaaagaagaagatccaactctcggacccctagtagggtcaatgaactcatcctcagtctgagtcggtgcggatcttgaagctgaacctctctgtctcctggagcatggcgcggaatgcagacgggaaggatcatgatgaaaaccaatctcctcatgctctcctgtaatctctgtaagtgcagggcaaggtaactgaatcatatggtgttgtgtctcgtctctgaaacaccaaaggaagttgcctttcagccagtgaaagttcttaagattactctcatccattgtgaatctcgtggtgttgacctcttctccttcaaagctgatgcaaaaatgctcaaatataggagtgagaagactgccaactctcttagatttcttccctttacgtgtaaagggcttggtcttgagtgagaccaagtgatgagcaaacacagcgccaaagttgacatcgtggtcaacctcctcaactccaaagctgtcatgaaagaaatcatgaacagcatcgtttctttgttattgtttttaagcatgttgtgtgagtagtgattaggatttctgaggatgggatagagtagttgtggaacccctagtcgaatatgttggttaagtgtagatatcttgaatcccttctcgattagttgtgtttactgcttattcgtttctgatcaactggaatccgatcccaaacgttccagcgcccagaaggcgtttaatgaaacgttggatctactaattccagtgataatcgtctctatcccaagggattggccgtttagagcggttattagctttaacagtcggttcttattgcctgtttagttagagattgctaatgggaattaggtcagtgtctagctatgcttgaggatttctatcacgagagtaaattaatctgttgttgaacctcttgtctagggatagcttaattgagatttgttaaccaactgagttgattagggagaccacactattcgattaccccatccttaggagtttctcatccatttgatttctctgtttacttacctgcttcattcacttgctattgaattttagtatttttctggtttcaaccattctactcgatcacactagtctactaacagtgagactgcgtgatagagtaaaatggtcaatttctgaattttcactctctgtcatcctgttgtacacaatcacagggtcccttctggcagttgaccctgcgatcgagtatatcggtcatttctgtgactttttactgttttctgcaacaacactaggactgttagaaaaccaaccaaattctgcttggcttgacttagcaacttctgatcatatctcatctgtttgcatcacacccatttggattgacacctaaaatactacaacgacaggatagtgttttaggattaattgatctgaaaaaacctactatcagttgttgtggaggatacaccttatcctcaggattggcaacgttggtgctgcggtaggagaggttggagttgttggttttgaagttgttgtatcctttgtagccaccttgattgttgatgtagctgacttcgtctaactggttcccctccccatcttggaattgagactgctcgtcatcaacaaggaagtgcacatgcttcttctaactaaggagaattctgtccagattgtcattcagtgctttgatctccttcctgtgtttgtcatcggagtcagctgtgcctctaacggtcctgtcgcagtcctcattgtaattaccatctgattgagccaggttctcaaccaattcctagccttcttcaacatccttgttctggaaattcccattgctggcggtatccagaagcatcctaatgcgtggtagaactcctctataaagagtgctgagcagagaggctttcgcgaagccatgatgagggcatcgattggtgtaacccttgaaaccttcccatgcttcacagaagctttcgccagtcttctgtgaaaaaccagaaatctgatttctgagtcttgcagttctggcgttggagaagaactttgatagaaaagccttcttgcaatcatcccaagtggtgattgattcatggggtagatgcttctcccagatgtgtgttttgtcgcccaaggagaatggaaacaaacagagcttcaatccgtcttcacagacaccattgatttttgttaggttgcagagcctatcgaattcatcaaggtggtcgagtggatcctccattggcagaccatggaatttggtccccttaatcatcgagatgagaccactcttaatctcgaagttgttgttctggatagcaggaggtgcaattcctttcctttgacgatggttccgtggtgcatctctaataccaatgttggcagggccattttgttgattctgttcgtcggccatttcgaatggttgttgaggtaaaaggttgactgtgtttctcctttctttgatttcgctagctatgcggtcgatgttgtcgttgaaaaggaggttctaattgcctgttgatcgagtttgcatacagcaaaggtgtacctggataaagaaaacaacaagaaaaacacacagttagtaatcgaaaagaaaatggaaaaagaactagatctaagcaagtctgaaatctcaaatgtaacaaacaaacacccaattggcaacggcaccaaattgataataggttttttagtcaattatcctaaaacactaatcatgtcgttgtagtattttaggttgtcaatccaaatgggtgtgatgctaacaatcaagatgtgatcagaagtcactaaatcaagccaagcaataacaggttttggtgtgttctagcagtcctaagtgaacatgcagaaaacagaaaatcaagtagaaacagtaaaacactcgaccaacacagctcgttgcagagcactgggtaaggtcgagtgacaggtcgagtaacaggcagtaaacgaaacaaagacactcgactacacagtctgttgccagacaactgggtggtcgagtatcaggtcgagtaacaggaaagaattgtagaaactaagcaacatatgacaagatgcagtaaacaacagtagagtaaacaataaaatcaatcagataaagaattcccaagatggggtaattgagtagtttcgtttcctcagtttacaagtgattgacatgctcagtaaattatccctagacaataagtttattaagtaaatctaagtgccaccgcaaaagagacccttaagttaccctagtcccagactcaatcaccattgacgagagctaacctgacaagtattacgaatcaacaagttaaagccaaaacgctccctgcaaccaataccttggtacagggccacgaatctctggaattagtggttcagacatttcatcgaacaccttttgggcgcagaaatgtctgggctcaaattcctgttgattagaaagcaataggcattaagaacaactaatccagaagggatctatcaatcaaactcaaccacttagcatactgagaattctaaactactctaacccatcctcagaaacctattcactactcagacaacattatagagaacataaacgttgaattgaatgaaaacatgataaacaacagtgtaatagcaaaatgataacaggattaacaacaataaacgaaatcaagaacaaatattgaatactaaatagattagagaaatccagattacaaaacatcaagaacacagtgtctccggaataaaacttaggttaacgaaaatgtaaagtacatgctccttatagcgaaatatttctgaaaccccaatactcaaaacgacgcagtattgggagggattaagaacggtactcgacccaggtggtcgagtgagtagtggagtgataagctggagtcttcttttcttccttgtgctcgagtgtctagttgagtgtggaatggagaagactctgaagctggccatcgagtatgtagtcgagtgatggtgatggtgatactcgacttcctggtagagtggtgtgatcgagtgatggtcaggtgtggaggtgatgatactcgaccaggtggtcgagtgaagtgatcgagtgactctcatggtggtactcggccaggaggtcgagtggtgaggtgaattgatgaagtcttctactcgaccaaggggtcgagtggtctgttgaggtcgtgaagcttctactcgaccagggggtcgagtggtttgacatgatcatgtccgcttcttccaattagctcgccaacagctccaaatcacctgaaaaacacaaatatgcaacatgcatgcaaaactatcctaaacatgcaaagtgatgagaaatgatatataacagtgatgatatgatgctaaagtgatgacaaatggatgctcaaaacatgcaaaatacacacttatcaggtcggcccaggaggcaggcgtatcctttggtgggtatcctttggtggcttatcttatagcggaatccagcatccatgttgaaccgtctacaaaatccactaggaaatcatactcctccttttcttctattaaagctatctccaggggatcctccagaatgatttcccctacacattctaccagacgcctcttctatctcatcgagatagataatctgatcatgagatgaagcttgcttgaaagtctcattcatatcaaacttcattatgaaatcgccaaggtgaaggtcgatttttcagttcgggacatcgataatggcgctggcggtagacaggaatggtcggccaaggatcagtggtccttatgctctttgtgaacttccaggataacaaaattaatagggatttgagatcccccaatcattatcggaatatcagccaaaatcccaacaggatggcggatagaacgatctgccagtattagggagattttagtttgtttgaaggtgtagtatccaagacggttagtaactgtgagcggcatcatgttgatgcttgatcctcaatcacataggcatcactcaaaaagttcatcatcaatagcacaagacaacacaaaactctcaggatcacctttctttcatgtcgtctggtcttgcaggatggcgctacactcttgggtcatcatcattacctcgtcttctaggctgatgttgttggttaagatactcttcatttatttcctaagagtggggatcatggcacaagcctcaacaaaaggtagccttaccgttaactacccgataagctctcgttgcttagctttctccttcttggtgctcttcccagcattcgggtatggtaccttaggtcagtagatacggtccgagggagagataagattggtcgcagtagtgctttcgcggcttggcggtacttcttcctcggcttcttggctaggaatgtgtatgggaggttctgggtctcttccactattcggatcgtgacaggtctcacaggcttgcttggattggtttttcttcctcctcctgatctttcggatactctggtgtctgtaagccatcccactcctcagtgttatggcttgcaatggtgcaccgatcagtgggtgcccttcttctgttctgaaggatttctcgtatgactcaatcaggcaggtagtctcattttcctattaagacaagtattcgaacttcctctaaagggaattaattttgctttttaagtcctcatgcatgatctggattgaggcgtcgacacttttttggcattcttgaaaactagcttcgagtctcttgatcaaaacctctagggtcgagttctcatttgccggtgttggaataggcaattctcactgaggttcctgaaactcgctaagaatagacctttgttgaatattaccttggtttgagattttccctcggttcctaaagctccggttttgggagactctcgggtggctcctcattggccccatgtaatttgcggtttcttctcgtccgtagaaatcatcaagttcctcggaggaagagctgaaaatcccttgagagttccgtacggcgatactcacaagactagatttcatccttggaggatttttccaagttccacatattttaaaaatatattcatttcgttaaaatctaagtgttgagttcgctcttcacaagactagatttcatccctcaaagattttttcaagtttcatctcttggaaaaatatattcattttggtgaaatctaagtgttgagtttgctattcacaagacaagatttcatccctcaaaaagttttccaagttccacctcttggaaaaatatattcatttcagtcaaatctaagtgttgagcttgctattcacaagacaagatttcatccttcaaggatttttccgagttccacctctttgaaaaatatattcatttcggtgaactctattttttgagctcgctcttcacaagactagatttcatccctcaaggatttttccaagttccacctcttggaaaaatatattcatttcggtgaaatctaagtgttgagttcgctcttcacaagactagatttcatccctcgaagatttttccaagttccagctcttggaaaaatatattcatttcgatgaaatttaagtgttgagttcgctcttcacaagactagatttcatgcctcaaggatttttccaagttccacctctcggaaaaatatatattatttcggtgaaatctatgtgttgaactcgctcatcacaagactagatttcaccccttaaggatttttccaagttccacctcttggaaaaatataatcatttcggtgaaatccaagtgttgagttcgctcttcacaagattagatttcatccctcaagtagttttccaagttccttctcttagaaaaatgtattcattttggtgaaatctaagtgttcagttcgctcttcacaagactagatttcatccctcaaggatttttccaagttccacctcttggaaaaatatatttactgtggtgaaatctaagtgttgagctcgctcttcacatgactagatttcatccttcaaggatttttccaagttatccttcaaggatttttcgaagttacactttttggaaaaatatattcatttctgtgaaatctaagtgttgagttcgcttttcacaagagtagatttcatccctcaaggattttttcaagttccacttcttggaaaaatattttcattacgatgaaatctaagtgttgagttcgctcttcacaagactagatttcatccctcaaagattttttcaagttccacctcttggaaaatatattcatttcggtgaaatctaagtgttgagctcgctctccacaatactagatttcatccctcaaaatgttttccaacttccaccttttggaaaattatatttaattcggtgaaatctaagtgttgagctcgctcttcacaagtgtacgattcaagatgaatcgtcttcaagtttagctcactaaacactctagactctcgtgtgtttgtttaagaatgaagaaacgacaccaagctttaactagttcaactaactgatgtggttagtttacgtctcgccggagattctccggaatccactagatcgctgataacgttctctctctacaaaggatctctctctctctcttatcttgttacaacaactcaatgaacgatgaaacagaatgagctaaagatataacgctaatactccttcgttgacttctcacctgttaaccacacgtgtgataattaaccccaagacttgaaccttcagtttctttgagagactctctgatacttagagaataaaggcatttgggtcacaactctcagttctccaccttgaccccaatgcagcgacctagcagccgaacttggactccaactccgtatacctgactaaactcactcagccttctaagcctttttgattaaacccactaagcttcagatcacgtgagtaaacccactcagcttgttgaggagccttatggctccattatgcttctgtaatcctgagtcgctctaacgcttcttgaagcttacccactggtactgtcttagtaaagatatctgcaggattacactctgttgcaatcttaaccagatttataaccccatcacttaccaaatctcttatgaaatgatacttggtatctatgtgtttagtcctttcatggaacactgtgttccttgccaaagcaatcgcactcttagagtcacagtgaatatttactgaatcctgcttaaacccaagttcattcatcagtcctagtaaccaaactgtttccttagctgcctctgttagagccatgtattcagcctcagtagacgataatgccacatccttttgcagacttgatttccagctgataacgttgcctcctaagtaaaaactatacctgatgtagatcttctcctgtcatgcagtatagtctgaatcacaaaacccttcaatcacaaaatctcctttgtttttatagcaaagcttcttcttgatagacccactgatataccttagaatccacttaactgcttgccaatgttgcttgagtggtttactcatgtacctgcataccaatcccacaggatatgcgagatctggtctggtacctatcattgcatacattaagcttccaactgcactttgatatggcacacccctcatagattcagactgaatccttaattcttcatctgtggcagcacgcaacttgaagtgtattcccattggtgttcctattggtttggattggtccatcccataagttccaaggacctttaggagatatccatcttgagatacagtgagagtacctttctgtctatctcttgatatttccattccaaggatcttcttagcttctcctagatctttcatttcaaattctgagttgagaagtgtttttaactcatctatatgattcttatcctttgaagctattaaaatatcgtcgacatatagcagcatatagacatagtctccactctgtaatctcttagagtaaacgcaactatcatattgactcctttcatatccatgtgactacacaaactcgttgaatcgattattccattgccttggtgactgcttgagaccatatagcgacctttgtagcagacacaccttcattggatatttttcatctacataaccttctggctgatccatgtaaatggtctcttataagtatccatgcaagttagcagtcttgacatccatctgttggagttccatatccaaatgagcaataatactgagcagaaaacgaattgacacatgtttcaccacaggtgaaaaaatctcctgatagtcaaccccttctttctgtgagtaacctttagctactactcttgctttaaatcgaggaccttccacacccactattccaggttttctcttgaagacccacttgcagcctataggcttctgtttttcatctctgtctactagtgaccaagttttgttcttcatgagagactctatctcttcatctgcagctgtgaaccacttgtcactattagcatctcttaatgcttcctgaaaactggagggctcagacttgccaccgtcttctgttacgaagtatgcgtatccggctatctcatctaattctgcttcttcagtgtattagtcttctagtctggttggtctcatgatctgtcttcttggcctgtgtttagctatctgatagctccctgacatttgattctcaactcttgttgacatttccactgaactttgtcctgaatttatcacagtatcttgctttaaagctccaccttaagaaatatcctcttcagacctgttatttcctgcaatatcacaagtagctttatcagataacattggtaaagggttagagatcatacatgactgtttctgagccatgatatccttgtacaacacatcctctttgaacaccacatttctgctaatggtgcacttcctgtcttctaacaaccaaaccctgaagcccttaactccttctggatatccggtaaagattcttttcttagccctcaaatttagcttaccatcatttgagtgaatgtaagcgagacatctaaatcttcgcaaacctgataagtctggcacagttgaagtccacatctcttctggaatgtgaaaatcaatagcagatgatggtgttctatttattaggtacactaatgtggaagctgcctcaacccaaaactgttgtcctaatccgctctcactgagcatgcttctgactttgttcataatcgttctatttaatctctctacaattccattttgttgaggtgtataggcacaggttctgtgtctcaccattccttccttcttgcagaaagtatcaaatctattattgcagaactcaagaccattatccgtacgaagcttctttactttcctttcactttgtgtttcaaccatcttcttccattgaacaaacatgtcaaatgcttcatcctttgtcctcaagaaatagatccagaccttcctggaccaatcatcagtgaaggagatgaagtattgacaccttccaagactcaatgggacgtttggagagccccataaatttgaatgaacatagtctagtttctctttagtgacgtgttgtgctgagctgaagctaactttgtgtgtttttccaaacacacaatcctcacagaacttaatacttgatactttgtcttttccaaaacaccctttctctgctaggccatccatccctttctgtcccacatgcctaagacgattgtgccaaagttttgttagatcttcttctgcaggtttctcttcaagtgccagacactctgacttcttagctcctgcttgtaaaatgtattaagactctcttcttgtgcctttcatgtacgtgatatcccctttcataacctttaacacaccgtttttgccttcgaactcacatcctttagagtccagagttcccatggagatcagattccttgacatccctggcatatatctgacatcgtgaagcataaaggtggtaccatccgagttcacaaacctcactttgccaataccattgacctctgtgaataagttgtttgccattctaaccatccctgttccaatttcctgaaactcaatgagcacatctcttcttggagtcatgtgaaacgagcaattgtgtccattatccactcatcttgatctgcattctcagtgagattcacttcagatgcgactagtccaatcagatcttgtgcatcatctttaaccagagctgattctccttgttgagaattagccttgttcctctcaatccacttatagcactgtcttttaaaatgtccctctttaccgcagatccaacagattttcttgccctctttcccaaacatttgatcattaccctttgcatgtggtcttcctcacacatacaagccttcaccaaccggtcttgaatcacctaagctatccctcagctccagctcctttgacttagcaacacttattacatcatccagccttataccttctctaccatatttcgatgtttttttcaacatatcatacttctctggaagagcactcaggatcaagattgcttgaacttcatttgggacttgaatctgaagattattcagatctaaaatcatctttaagaactcatcaaagttttcctcaagagtcttcgattcttgcatcatgtagttgtaaacctttagttgaagatatacacgatttggtaaaatctttaccaaatacaatctctcaagcgttccccaagcttccgctgcagattttgaatgttttcttgatcttagaaccttatctgcgacattgatgaatataatgtccatcgccttctcatctcgctctattctagcctcttcctcctcgatccacttcttcttctttgcaggatctccttcttcttcttccgtgagaggtttatgtggtggttgctccaccagagcagtctttagccccaacactctgaggtgagcgaacatccgagttctccagagggagaagtcaccctatccatcgaattgagcaatctttactttcgaatccgtcattcttataaccgatcttcagattattgatgaaccagagctctgataccaatttgtatgattcaagatgaatcgtcttcaagtttagctcactaaacactctcgactctcgtgtttttgtttaagaatgaagaaacgacaccaagctttaacgagttcaactaaccgatgtggttagtctacgtctcgtcggagattctccggaatccattagatcgccgataacgttctctctctacaaaggatctctctctctctctctctctcttatcttattacaacaactctatgaacgatgaaacagaatgagctaaagatataacgctaatactcctgtgttgacttctcacgtgttaaccacacatgtgacaattaacacgaagacttgaaccttctgtttcttcgagagactctctgatacttagagaataaaggcatttgggtcacaacactcaacaagactagatttcatcattcaaggatttttccaaattctaaatcttttaaaaatatattcatttcggtgaaatctaagtgttgagtttgctcttcacaagactagatttcatacctcaagatttttttcaagttccacctcttggaaaaatatatccattttggtgaaatctaactgttgagtttgctattcagaagacaagaattcttccccaaaaagttttccaagttccacctcttggaaaaatatattcacttcatttcggtgaaatctaagcgttgagcttgctattcacaagacaagatttcatccttcaaggatttttccgagttccacctctttgaaaaatatattcatttcggtgaactctaagcgttgagctcgctcttcacaagactaaatttcatcacttaaggatttttccaagttccacctctcgaaaaatatatttatttcggtgaaatctaagtgttgagttcgctgttcacaagactatatttcatccctcaaggatttttccaagttccacctcttggaaaaatataatcatttcggtgaaatccaattattgagttcgctcttcacaagattagatttcatccctcaaagatttttccaagttccacctttttgaaaaatgtattattttggtgaaatctaagtgttgagcttgcacttcacaagactagatttcatccctcaaagatttttccaagttccacctctcgaaaaaatatattcattacggtgaaatataagtgttgagctcactcttcacaagacaagatttcatccctcaagaatttttccgagtcccacctcttggaaaaatatattcattttggtaaaatctaagtgttgagttcgctattcacaaaattatatttcatccctcaaggattttttcaagttccatctcttagaaaaatgtattcatttcggtgaaatctaagtgttgagctcgctcatcaaaagactagatttcacccctcaaggatttttccaagttccacctgttggaaaaatatatttatttcggtaaaatccaagtgttgagttccgtcttcacaagattagatttcatacctcaaggatgtttccaagttccacctcttggaaaaatgtattcattttggtgaaatctaagtgttgagctcgctcttcacaagactagatttcatccctcaaggattttttcaagttacaccttttggaaaaatatattcatttcggtgaaatctaagtattgagttggcttttcacaagactagattgcatccctcaaggattttttcaagttccatttcttggaaaaatatattaatttcggagaaatctaaatgttgagttcgcgcagtcacaagactagatttcttccgacaaggatttttccaagttccacctcttggaaaagtatattcattttggtgaaatctaagcgttgagttccttcttcaccacaccatatttcatccctcaaggattttccaagttccacctcttggaaaaatatattcattttgttgaaatctaagtgttgtgtttgctcttcacaaaactagatttcatccctcaaggatttttccaagttccacctctgggaaaaatatatccatttcagtaaaatctaagtgttgagttccctctttacaagactatatttcatccctcaaagatttttccaagttccacctcttggaaaaatatattcatttcggtgaaatctaagggttgagctcgctcttcacaagactagatttcatccctgaaagatttttccaagttccaccttttgagaaaatatattcatttcggtgaaatctaattgttgagttagctcttcacaaaactagatttcatccctcaaggtttttccaagttccacctcttggagaaatatattcatgtcggtgaaaaataagtgttgagctcgctcttaacaagactagatttcatccttcaaggattttttcaagttccacatcttttaaaagtatattcatttcagtgaaatctaagtgttgagctcggtcttcacaagactagattttttccctcaaggatttttttaagttccacctcttgaaaaaatatattcattttggtgaaatctaagtgttgagttccctcttcacaagattagatttcatacatcaaggatttttccaagttctacctcttggaaaaatatatttattttggtgaaatctaagttttgagtttgctcttcacaagaatatatttcatccctcaaagattttttcaagttccacctcttggaaaaatttattcagttcggtgaaatctaagtgttgagttcgctcttcacaagattagatttcatccctcaaggatttttcaaagttccagctctcggaaaaatatattgtttttgatcaaatctaagtgttgaactcgcttataacaagactagatttcacccctcaatgatttttcctagttccacctcttagaaaaatataatcgtttcggtgaaatccaagtattgagtgcgcacttcacaagattagatttcatccctcaaggatttttccaagttccacctttttgaaaaatgtatttattttggtgaaatctaagttttgagcttgctcttcaccagactagatttcatccctcaaggatttttccaagttccacctctcgaaaaaatatattcattacggtgaaatataagtgttgagctcgctcttcacaagacaagatttcatccctcaagaatttttccgagtcccacctcttggaaaaatatattcattttggtaaaatctaagtgttgagttcgctattcacaaaattatatttcatccctcaaggatttttccaaattctatctctcagaaaaatgtattcatttcggtgaaatctaagtgttgagctcgctcatcacaagactacatttcacccctcaaggatttttccaagttccacctcttggaaaaatctattcatttcggtgaaatccaagtgttgagttccctcttcacaagattagatttcatacctcaaggatttttccaagttccacctcttggaaaaatatattcattttggtgaaatctaagtgttcagctcgcacttcacaagactagatttcatccttcaaggatttttccaagttccacatcttttaaaaatatattcattttggtgaaatctaagtgttgagttggcttttcacaagactagatttcatcctttaaggattttttcaagttccacctcttggaaaaatatattcatttttgtgaaatctaagtgttgagtttgctattcacaagacaagatttcatccctcaaaaagtttttcaagttccacctctcggaaaaatatattcatttcggtgaaatctaagcgttgagttcgctcttcacaagactacatttcatccctcaacgatttttccaatttcacctcttaaaaaaatatattcatttcagcgaaatctaagtgttgagttcgctcttcacaagactatatttcatccctcaaagatttttccaagttccacctcttggaaaaatatattcatttcggtgaaatctaactgttaagttcgcttttcagaagactagatttcatccctcaagaatttttccaagttccacctcttggaaaatatatttatttcggtgaaatctaagtgttgaactcgcttatcacaagactagattttaccgcttcaggatttttccaagttccacctcttggaaaaatataatcatttcggtgaaatccaagtattgagtgcgcacttcacaagattagatttcatccctcaaagatttttccaagttccacctttttgaaaaatgtatttattttggtgaaatctaagtgttgagcttgctcttcacaagactagatttcatccctcaaggatttttccaacttccacctctcgaaaaaatatattcattacggtgaaatataagtgttgagctcgctcttcacaagacaagatttcatccctcaagaattttttcgagtcccacctcttggaaaaatatattcattttggtaaaatctaagtgttgagttcgctattcacaaaattatatttcatccctcaaggatttttccaaattctatctctcagaaaaatgtattcatttcggtgaaatctaagtgttgagctcgctcatcacaagactacatttcacccctcaaggatttttccaagttccacctcttggaaaaatctattcatttcggtgaaatccaagtgttgagttccctcttcacaagattagatttcatacctcaaggatttttccaagttccacctcttggaaaaatatattcattttggtgaaatctaagtgttcagctcgcacttcacaagactagatttcatccttcaaggattttccaagttccacatctttttaaaatatattcattttggtgaaatctaagtgttgagttggcttttcacaagactagatttcatcctttaaggattttttcaagttccacctcttggaaaaatatattcatttttgtgaaatctaagtgttgagtttgctattcacaagacaagatttcatccctcaaaaagtttttcaagttccacctctcggaaaaatatattcatttcggtgaaatctaagcgttgagttcgctcttcacaagactacatttcatccctcaacgatttttccaatttcacctcttaaaaaaatatattcatttcagcgaaatctaagtgttgagttcgctcttcacaagactatatttcatccctcaaagatttttccaagttccacctcttggaaaaatatattcatttcggtgaaatctaactgttaagttcgcttttcagaagactagatttcatccctcaagaatttttccaagttccacctcttggaaaatatatttatttcggtgaaatctaaatgttgaactcgcttatcacaagactagattttaccgcttcaggatttttccaagttccacctcttggaaaaatataatcatttcggtgaaatccaagtattgagtgcgcacttcacaagattagatttcatccctcaaagatttttccaagttccacctttttgaaaaatgtatttattttggtgaaatctaagtgttgagcttgctcttcacatgactagatttcatccctcaaagatttttccaagttccacctctcgaaaaaatatattcattatggtgaaatataagtgttgagctcgctcttcacaagacaagatttcatacctcaagaatttttccgagtcccacctcttggaaaaatatattcattttggtgaaatctaagtgttgagttcgctattcacaaaattatatttcatccctcaaggatttttccaagttccatctgtcagaaaaatgtattcatttaggtgaaatctaagtgttgagctcgctcatcaaaagactagatttcacccctcaaggatttttccaagttccacctcttggaaaaatatattcatttcggtgaaatccaagtgttgagttccctcttcacaagattagatttcatacctcaaggattttttcaagttccacctcttggaaaaatgtattcgttttggtgaaatctaagtgttgagctcgctcttcacaagactagatttcatccctcaaggatttttccaagttacaccttttggaaaaatatattcatttaggtgaaatctaagtgttgagttggcttttcacaagactagattgcatccctcaaggatttttccaagtttcatttcttggaaaaatatattaatttcggagaaatctaaatgttgagttcgcgcttcacaagactagatttcatccgtcaaggatttttccaagttccacttcttggaaacattttggtgaaatctaagcgttgagttccttcttcaccagaccatatttcatccctcaaggattttccaagttccatctattggaaaaatatattcattttgttgaaatctaagtgttgtgtttgctcttcacaaaactagattccatccctcaaggatttttccaagttccacctctcggaaaaatatatccatttcggtaaaatctaagtgttgagttcgctcttcacaagactatatttcatccctcaaagatttttccaagttcaacctcttggaaaaatatattcatttcggtgaaatttaagtgttgagctcgctcttcacaagactagatttcatccctcaaagatttttccaagttccaccttttggaaaaatatattcatttcggtgaaatctaattgttgagttagctcttcacaaaactagattttatccctcaaggatatttccaagttccacctcttggagaaatatattcatgtcggtgaaatctaagtgttgagctcgctcttaacaagagtagatttcatccttcaaggattttttcaatttccacatctttttaaagtatattcatttcggtgaaatctaagtgttgagttcggtcttcacaagactagatttcatccctcaaggatttttttaagttccacctcttgaaaaaatatattcattttggtgaaatctaagtgttgagtttgctattcacaagacaagatttgatccctcgaaaagttttccaagttccacctttcggaaatatatattcatttcggtgaaatctaagtgttgagttcgctcttcacaagactagatttcatccctcaagaatttttccaagtttcacctcttgaaaaaatatattcatttcagcgatatctaagtgttgagtttgctcttcacaagaatatatttcgtccctcaaagattttttcaagttccacctcttggaaatgttttttcatttcggtgaaatctaagtgttgagttcgctattcacaagattagatttcatgcctcaaggatttttccaagttccagctctcggaaaaaatatattcatttcgatcaaatctaagtgttgaactcgcttatcacaagactagatttcacccctcaatgatttatcctagttccacctcttagaaaaatataatcatttcggtgaaatccaagtattgagttcgctcttcacaagattagatttcatccctcaaagatttttccaagttccacctttttgaaaaatgtattattttggtgaaatctaagtgttgagcttgctcttcacaagactagatttcatccctcaaggatttttccaagttccacctcttgaaaaattatattcattatggtgaaatatatgtgttgagctcgctcttcacaagacaagatttctatccctcaagaatttttccgagtcccacctcttggaaaaatatattcattttggtgaaatctaagtgttgagtttgttattcacaaaattatatttcatccctcaagaatttttccaagttccatctctcagaaaaatgaattcatttcggtgaaatctaagtgttgagctcgctcatcaaaagactagatttcacccctcaaggatttttccaagttccacctcttggaaaaatatattaatttcggtgaaatccaagtgttgagttccctcttcacaagattagatttcatacctcaaggatttttccaagttccacctcttggaaaagtgtattcattttggtgaaatctaagtgttgagctcgctcttcacaagactagatttcatccctcaaggatttttccaagttacaccttttggaaaaatatatttatttcggtgaaatctaagtgttgagttggcttttcacaagactagattgcatcccttaaggatttttccaagttccattgcttggaaaaatatattaatttcggagaaatctaaatgttgagttcgcgcttcacaaaactagatttcatccctcaaggatttttccaagttccacctcttgaaaaagtatattcattttggtgaaatctaagcgttgagttccttcttcaccagaccatatttcatccctcaaggattttccaagttccacctcttagaaaaatatattcattttattaaaatctaagtgttgtgtttgctcttcacaaaactagatttcatccctcaaggatttttccaagttccacctctcggaaaaatatatctatttcggtaaaatctaagtgttgagttcgctcttcacaagactatatttcatccctcaaagattttcccaagttccagctcttggaaaaatatattcatttcggtgaaatctaagtgttgagctcgctcttcacaagactagatttcatccctcaaagatttttccaagttccacctcttggaaaaacatattcatttcggtgaaatctaattgttgagttacctcttcacaaaaatagatttcatccctcaaggatttttccaagttccacctcttgaaaaatatattcattttggtgaaatctaattgttgagtttgctattcacaagataagatttcatccctcaaaaggttttccaagttccacctcttggaaaaatagattcatttcggtgatatttaagtgttgagcttgctcttcacaagacaagatttcaaccttcaaggatttttccgagttccacctttttgaaaaatatattcatttcggtgaactctaagtgttgagctcactcttcacaagactaaatttcatctctcaaggatttttccaagttccacctcttagaaaaatataatcatttcggtgaaatccaagttttgagttcgcttttcacaagattagatttcatccctcaaggatttttccaagttccacctcttgaaaaaatgtattcattttggtgaaatgtaagtgttgagttcgctcttcacaagactagattttatccctcaaggatttttccaagttccacctcttgcaaaaatatattgatttcggtaaaatctaagtgttgagctcgctcttcacaagactagatttcatctttcaagtatttttccaagttacacctttttggaaaaatatattcatttcggtgaaatcgaagtgttgagttcgctcttcacaagactagatttcatccctcaaggatttttccaagttgcacttcttggaaaaatatattcatttcggtgaaatctaagtgttgagttcgcgcttcacaagactagatttcatccgtcaaggatttttccaagttccacctcttgaaaattatattcattttggtgaaatctaagtgttgagtttgctcttcacatggctagatttcatccctcaaagatgcttttgatgtccgaccatcggaaaaatgtgctcatgtcgatgaaatttatgtatcgatttaactcgtcatggactcaaattccaggtaaagcggtggcgattcacttttttcggaagcaagaaactcgtaaaagcaaaaaaaaaaaaaaaaaaaagaggacatcaacgtctcatgatgttctgagatttcccattagctacacaaacttcaccaaagaactcctggacctcaacaagactacagctcgtggtggcgaaacaacaaccttatcacctccaaagtaggagcacaagtctaggtagaagcaaggttgagtctactaaggtcaactcaatcgatcaagccatgacacaatgatacagagaagttttcttggcgtttcttcagaaatcattagctgatgacttcaacaattacagccatgacaagacaagatcatattggctcgaaacatttggatcacatcatgtatgaagcatcaaagataagttcaactatggtgtacacgtttactccttaacaggaatgtctccatcttaagttatgcaaaatgttatgacgaaaagcatagatgtctaagaccaaacaggtgggggcgtgttccaaataatataaagcaaagtcaagcctcttcggaggagaattatacagtattatcacttaacgtgattgacgaatcattgctacaagtttggagtccatatttatatcatcactcaaaattcaaggagtcaaaatgcgagatttgtcaacaagaagagattcaagtttgaaaaagacaacttcgatgctataccacaaccttccaatgctattcaccttcatggagatgtgaattccaattggtggaatctaagtgttgagtttgctcttcacaaaattagattccatcgagaagagatttctccaagttctagctcttggaaaaatgtgttcattcgatggaatttaaaagtttttccatagtttacctgctttattccgagcaatcaatcggatagaagtggaagacgagaagattagcttcacttcgcaaaaaaaagaaagccggctatgccaattgttattgtcccttccaggaaaccaaagttaaagggcaacaaagagatcaaaccacttggattaaacccgtttaacaataatatggagacatcatctgtaacacccctatcccgctataaaaacataaacgaaataggagtgtcacgttgaacgcccgtagtcggccaacccaggtttccgaaacgaattcgttcgcccgagtcgtccaaccgcaagagtccagcctcccgcccgtggcctaaggcttttcaacccgtaccgcggacgcgagtggtgatagtccggaaaagacaaatatcagtcagtatacccatataaattttagaaatccgagtcttatatatatatatatatatatatatcatacgagaaatggttagcaaaacgtatatagttttcagatcctctttgaaaaccatatataatatacttagtaagaatttacaaaaagccgtaaaacctacattggttcgtcctaagtcacgagcaccctctacaaggttggtcaactaagttttcctgaaaaagataagtagcgtcataagtaatctagcattacttagtgaaccccggatctatatagtgttatcgtaatacccttccttaccccctaagcagcaacaacacgtaacaataatactacctaacaagcaagacataaacaaagataacacgcaacatacaacacaagcaaaatataatgcaccatgcagaatgcatgcagactcgaatttcctaatatgcagcggacaactaatgcaagcatgcttctatcaacctaggtaaggccttctacgaatccatgatctcccaaggacatgcctccatactcttagacacaaagtctataagagacataacattcctttagactatatggtccaaggttggtgattaggtcggccaaggcaagcacgaggtggcccagaccaatcaaaacgttaaaattgtcgaccaacagccgctccgggacactaatcggcctccgattggttccttccctttttcgaataaacatcatccaaaaatggataagcacgaccctaaaagaataaggatgaccggaatatggataaggtttagccttaacggataaacatgagccaccgttaaatcctggccatccgtttcctcattctaaccaaacatacgatctgtcactggaccgcaagaacattaatacggcacactctgttccaatgtctcatgagggtccatgatgcaaatcaaggcttccttaggactataacacgttccatgccagaattaaccgagtaagccagctatcgtcacttatccgcattctccaatcaaccctcgaccattcacgacccatacatatcctattgtccaaatggattcccctcgactttctaatgtttcctagaccgaaactaggtttccttaagctatcctagttcttagggctaacctaatggtttcggggtttaccggtagtcgcatcgtaactaagcttggttcgtctgatggagagtgatccctttaccatggacttgatcctattcaatgctccttacccatgacttgccacactaaatggccgaactgatcttgccttttttttgcttgatctcgcattctactcgacagactgtacgtccggccgcatagtcaaggttatgggcattacatccttcccccccttaaaagaatttgtcctccaattctaaggactaaggaagtaactagccttcaaggcaaaccgattcctttgttggttccatgaagctttgtgtagaaaggataggtttggtctcctccatttttttattgcaatattttcctccattcctaggaagttgatgcatgcctaacggactccgccactttcttttcttgtatgtgatttttgtcgtcaccacatacggtttagctaacgatttaatttatcggcttcctagtactactaggcttggtccacaaatcctaaggttccatcctaatttttatggttctctcctaactcttttgaatgggcttcagacttcctatactttctagttcctatggtttggtacttggttaagtacgaaaccaaacacacacataaatacattaataacttgaaagtaaatcaagcaatcacacaaaaggatattagtataaacataatgtaacataacattagttaacagccctaaggggaaaggaggtgattttgactatcgtacacacctgcttattcaagcctatagatatcatcaaaaagatatcacaatgtaaccgaaggttactattggctcccttgtagtcgtcgctatacatcaaaaaatggggttagtttcctaatatttactaaggtttatgactcctaagggaatcagagtaaccctaagctacacctcgaacatgtacagcctagaaaaagatcctcctccgtgtcgggaatcggtggggatgatggtcctgctacgtgagatggggaagtactagtcggtgcaggaatctgaccgtcatctctcattatcatacaagttgccgtgtaatgcccatactctccactgtaaagacaagcaatggccatgggcatatactgcgtgtataactaacagtcctcgggtaataaacatcctcaccaaagatgaagcagaacggtatctggatacccgatgtggagcccccgtcaaatgtcagaatagcgtcagccctcatttcagccgtgaaacaaagtatgggggacatgccctcccataacagtgcaaaagggctatcgggagagtgatcgatagcctccggaacgtatggagaaaccggtggatcctcatcctcatccggatctgactcataggatatcgatgaatacgggttaagtgcaaaggatggtgtggcagaactgctcgtgggaacactcacatagacatggaccatcacgatctcatgtcccttcagagccagctcctgctccaccgtcctcactcccgtgatcacacattcatcctcacaatccgaatcgatcatcatcccatcccctatatgcacatcctcctgctctgacagagcaactatccctgcaagaccaaaatcagcaaccgtatcactcgatctagtctccgatataacccgggaacactcggccacatcccttctcacacacctacccatgactctctcacgaaggtcatatcgcctggacgacagacccaaggaccgtccctcctcctccacagactcccaccacgtgatctctttagcgggatactataatacaaacaaagaggttaagacacgaaaatacaagcaaaagggtaagccacctataatactaacaacaagggtaagccaacctaaacaaaaagggtttgttctataggtcaatctacctaaactctagcaagtgactgaacaaatttcctaatagctttttacgacacatttactcgataaaacattgaaaaccatggtttctcgtagcgtcacaaaccatgctctgataccaccttgtaacacctctatcccgctataaaaatataaataaaataggagtgtcacgttgaacgcccgcagtcagccaacccaggttttcgaaacgaattcgttcgcccgagtcgtccaaccgcatgagtccagcctcccgcccgtggcctaaggcttttcaacccgtaccacggacgcgagtggtgatagtccggaaaagacaaatatcagtcactataaccatataaattttagaaatccgagtcttatatatatatatataacaaaacgtatatatatatatatatatatcatacgagaaatggttagcaaaacgtatatagttttcagatcctctttgaaaaccatacataatacacttagtaagaatttacaaaaagccgttagacctacattggttcgtcctaagtcacgagcaccctctacaaggttggtcaactaagttttcctgaaaaagataagtagcgtcataagtaatctagcattacttagtgaaccccggatctatatagtgttatcgtaatacccttccttaccccctaagcagcaacaacacgtaacaataatactacctaacaagcaagacataaacaaagataacacgcaacatacaacacaagcaaaatataatgcaccatgcagaatgcatgcagactcgaatttcctaatatgcagcggacaactaatgcaagcatgcttctatcaacctaggtaaggccttctaggaatccatgatctcccaaggacatgcctccatacttttagacacaaagtctataagagacataacattcctttagactacatcgtcatgtagcgcccagtcggtagcgatccagccctaaggccttcgtatgccataacggaacggagttacacgtgatgcacaacatacagacgggattctcatgattcgactaatgctagacatctaattaaagactaactaacatgaaaacagactcacatactatcatgcattcatcatatatatatgcaaaactctactaatcaaacaactaatcacacttaattattactaatcacggttagtccccctaatcatggtttaactaaccctaatcatgcttaagaaatacttaccctaattaatgaacactaatcctaattaacaattactaaacctaattaactatcctaatcaaggattaagcgaataattaagctaagtaatcataattaacctcctaagctatattaaggaaataaatgaataaactatcctattcacgtgctacttcacgtaactcaagactcacttggatttccgagtggtttggcttctgaatgttttctcccgcgaactaagctgttctaagcgatttttgggtctgaggaatcaaatgggcggagggggtatttatatggtccaaggtcggtgattaggtcggccaaggcaagcacgaggtgtttggaccaatcaaaatgtgaaaaatgtcgaccaacggccgctccaagacactaatcggcctccgattggttccttccattttttcggataaacatcatccaaaaatggataagcacgaccctaaaaggataaggatgaccggaatatgtataagcttgagccttaaaggataaacatgaggcacgattcaatcttggccgtccatttcctcattccggcgaaacctacgatctgtcaccagaccgcaagaacattaatacggcacactccgttccaatgtctcctgagggtccatgacgcaaatcaaggcttccttaggactataacacgttccatgccagaattaaccgagtaagccagctatcgtcacttatccgcactctccgatcaatcccgtgaccattcacgacccatacacatatctcactgtccaaatggatttccctcgaccttctaaggtttcctagaccgaaactaaggtttcttgaagctatcctagttcttagggctagcctaatggttttggggtttaccgatagtcgcatcgtagctaaacttggtccgtctcatggtgtgtcattcctttacccatggacttgatccaattcaatgctccttacccatgacttgccacactaaaaggccgaactgatcttgcctttttttggctagatctcgcattctactcgacagactgtacgtccggccacatagtcaaggtcaggggcattacaccatctcttgggaaagagaagatcgagacaaccatctctaacaacatggttgcgatgaaaaggcatacgacaacatccatagagtaaattattatactacaaaagactgtaccgatttcaagaggcatcttcctgagctacggacaattggtgacctcgcaaaaccttgacatcggagagttcgtgaaaacttaccacgaagaaaaggcggaagtcaaaaattcatcactagctaagaaaatacctaaaacatcaaatcccggagtttcttttggttctaagaagaagattgaagtaatcatgaataggtctaagttttgtagagattcgaccactacaatcaaaaagtttaagggaatgttctattaaaggcgagcacaagcgacaaactcgaactcgctagagcaatcacaatgttcaaggaagaagaaattcgtcaccttgcagaacctgatgacgttgattttgtcctcaccttagacgtggctgacgtcggggtttcaaggattgtgattgatgttggaagtttgatagatctactattcttgaatacgcttagagagaatggaaagtagcgaggctgacatagttggagccccatgaatttatcggatcaaggttatcccatcaatctatcgtcaatacgttaaatatttaatcccgaatggtgtgaaaattttacaaggagatcaagaatcttcaaaatcttgttatttaacgactcatcggatggttatccaattaacaaatctcgtgaagaaagaagtgattttaggaatatcaagtgggcaagtagtggatgacgtcataatcaaagtgaccatcgattagaaagatcatgaacgaacaatttggaagaaagtagcatctagttacaaccaaataacgatgaatgatataattcaaattaatcctaagaccactctctctaataaagagttcagttgcagcacttagggaacgaattcacaaagttctcggatcacgtagtagactaatggctaatcgaattaagctaagtaaaacagtaaagaaaataaaagaaagaaaaagtaagcaataccaatcaattgggagttgtgaaaacaagataataaaggcgtcaggcttagagtattctcacgaaatagatgatactagatctagaaatagctaggttattatcgaaccgttctcgaattcaaactatgattttagagtaaccggtggtgttccgtaaaactctctatactcagagctaagattaccagagaagccgagaaatcctatactaaagcatgcattattatcaagtttgattagttcacctagtatctaaacca

SEQ ID NO: 211 - DNA, 1082144 bp, Arabidopsis thaliana
ccgctgtggaacctgaaaggtacaaggccagactagtagcaagaggatttacacagagaaaaggaattgactatgatgtagtgtttgcacctatagtcaagcatgtttgtataagaatcttgatgtccattgttgttcagggagatctagaattggaacaaatggatgttaagactgcgttcttgcatggtgatctggataaaccactctacatggagcaacctgaggggtatattgctgatgaacaaaaagatcaagtgtgcttgttaaagaagtcactgtatgggtttaaacaagcgccacgttagtggaacaagaagtttaactcctttatcatggatcagaagtttatcagaagtggtcatgattcgtgtgtttacataaaacaactcagtgatgaggagtttgtgtatctgctgatatacgtggatgatatgttgatagcagctaagtccatgactgaaattaacaagatcaaagaagcgttgagtacatgttttgaaatgaaggatatgggtgcagctagtcgaatactgggaatcgacattattagagacaaaaaagttccatactcaagtgctattggcagcgttatgtatgccatggttggcaccagaacagatgtagctcaagctattggagttctaagcaggtttatgggcaggccaggtaagattcattggattgcagtaaagtggctgctaatatacttaaaggggtctacagatttgaatctggttttcaccagagaaaaagatttcagagttcagggtttcagtgactctgactatgcagcagatcttgacaggaggcgttcaacgacaggttatgtgttcacagttggtggaaatacactgagttggaagtcaaatctgcagagtataatggcattatcaaccactgaagcagagtatgttgctttaactgaagcagtgaaagaagctttgtggattcaggggttgttaacagaaatgggattcaagcaagagaaaattactttgtggtgtgactcgcaatcagccatcagtctgtcaaagaacaacacgttccattaaagaaccaagcacattgcgattaagtacaactttatagggatgtgattgaagaaggaagtgttgaagttctcaagatacacacttctcggaatcctgcagacatgcttaccaaaggcattcctgtgcagaagtttgaggcagctttagagtttctaaagctactcaggtgaggtggaaagacatctcatccaaaggtgaaatccaagtaagtgcacgttcactagttatgaagagatttgaatcaaggtggagtgttgttggtttatagctctcattcaaattctgaagttggttttgtttaagtcaattgaagattgaagcagaccgggtgtgtctagttaggagtgttataacaggtgcaagcgagattgcataaatgaacgataaacacgacacagatttaacgtggttcaccaacactttctgttggctacatccacgggcaaagagacagattttattactggagaatacagaattcagaatacagggaggctaggttaagaagtgtacttatacaaaagaaaccctaattaaccctaaactgattgggcctaaagtcatgggcccaatctattcaagtcatatctaacaaggaggttactgattaaattggaaattgaagaagagaagttgaagactctaactgcagtggagggtttgactactttatatataaagagtaacagagtttgttacattcattatcttcttcatctgtttctttctatgagttttcttgtattgtgagagagagaacttgagagaatcaccattgttgtaagctcggtttgagctgtactcttcatcaaagttagtagatttgctggattgattcggctccggacgtaggcttgatcacaccgatcttgctgaaccgggtaaacaaaccttgtgtcttcgttcttcttcaacagttcttaaatcttgtgtgtgttgagatcgatcaaacgtaacaaaaaattgatcatcttcatatctagattcaaacgaatcgcagctcaatttctaacactttctctgattcgtttctcaaaaaaatctcattcctcgctccattatggcttgcaattttgggtactctatgtctttccgagctttagcgttgaagacatccgtcaaacattcctcagccactttctcaaggatcttgatcggaagctgatcattgcttttaaagataacgagattgagagaagccaatcgcttaatcccgatcttaaacgaccgattagagattcgagaattgcgattgttatcttttccaaaaactacgcttcttcaagctggtgtttaaatgaattgctggagattgttagatgcaaagaagatagcaatcgattggtggtgattcctgttttctatggcttggatccgtctcatgttaggaaacaaatcggcaattttggaaaaatctttaagaagacttgtcaaaacagaacagaggatgagataaatctgcggaggagagctttgatcgatgtagctaatactctcggatatcattctacgatttggtatattccttcttgatttgattattcatacttgttctgttttgagcttgctttgtttgttgatttgttttgttttttgagttagtaaagcaaatatgacaaaagaaatcaccaatgatgttttggttaaactgaatttaactccatcaaatgatattgaggattttgttagtattgaagatcatatagcagagatttggaatctgaggaagtgaggatggttcggatttggggtttttatttagtcgtctctctcgtcatttccaaggtagtgtcttcatagacggtgcttttgtatctaagtgtaggaaggattaccctaaagccaaaccagatgactataacatgaagttgcatttgctacaagaaaacagctcgtcaacgactataattatagtcgcttttatagtcgttattttggattttatgactatttggcgactaatgtaagtagttgtaaatcagtaatcactagaatgagtagtcggtaacttagtccataaaatggcgactaattgccgactatgcctaatgttgaaagtttggcgttgaatagtcattatttaatcgtcaaatttaatgaccattttacgactaattttcgataaactcagttgatcatatgttttggtaaacgtagtcgtacattagtgggtaaaatttaatgaccgttttacgactaatttacaattatctctattgaatattctgtttgctaaacacagtcgtgtattagtcggcaaatgtttaatgactaagttacgactaatgtttaacgactaacaagcgactaagtaaaaagttagtgtaaataattgtagacgtcacatagtcgttaaattagtgaactattttttttattgtctaactatattgttacgactatattgaaactgagacagaacttaaaccaaatgcaaaaaaaaattacaatgcaaaaatatttgaaacccaaaccaaacaacattaagtactttgttcattacaaaatgcaagagaagttgaaacatacatagagtttaagttcagaaaagagttaagagatatgcaaccgaacttagtgacatagagttttaagttcaagaaagagttaagacatcacaacctatgaagcaaatggagatggagttgtagtacaaacttaattcgtacgtttaccaaatccccaaatcacattaggttataaacatttgggttgcaatggcaacacatatagcaacaaacaggttttcgtagatggatttaggaaactctttgaaacacaacaatggcaagcggatgtacggctcaaggcaggagcagtgatgagagtacatacaactgtccccacccacacttgttctggtcttctctacttctttctcttctctcttactattgtaaaggctaaaagcctaaacaatttagcaatggatttgagagtaaaatgctttttatcgttagtggtatttaatggaaatttgaataggcacccaaagtcttttaaaaggtgttgaaatcagacgatcgagttcaatgcttatgtaaacctaaagagataattactctctttgagatgaaacatgataattagtccttttttcccactttgctaatacttatgttttgtttaatataattatcaatagaagagagataataatttaagaattttcgtatattgatttatgtctcattttatttccaaaaacgtcttggaaaacgaaagtaaaagtaaagagtaattttgaccgtctatgctctctctatatatgtataagctacattcgttttctacattagaaccaactaaccaagttatacgatatagctatggggacacaaacaaacaaatatattttctttgatagattactgaaggttataaaagaacaaccagccgatgtacggctagaggcatgggacagtgataaggatgcagctatcatgcagccgacaaatatgagattccttgacaacgacttacgctctctcacccttggcgacctgtctgtgcatgattattgccagaagctcaagacactctccgatctcctcgccaacgttgactctcctgtctctgatcgtgtcgtcgttacgcatatgctcaatggactttctgaaaagtttgacaacatcatcaacatcatcaagcatcgccaaccgttcccatctttctctgttgcccgatccatgctcattgaggaagaacgtcgtctctccaagcaggtcaaaacaggatcctctcactcagccaactcatcgtctcccaatgtgctctatgtaacgtctaatggaaatcaaaactccatgtctcgcgacaacaatcacaacacttatcgtgacaacaacaacaccggctaccgcgacaacaaccacaacaactacaatgggcacaacaacaatggtagaggtcgtggacgtggacgtggcggtaccggcagtaacggcagaggtcgtggacgccaaaactggcaatggaatcctcgcaattggcagacacaacaaccatggctctcaacaccaaccccatatccacactggccacaacaaaactggatgcaaagaccaccgatggcatacttgacagccacgaacccagcagcagggctccttggttcttctccacaagcagctatggttggttcgactaatcaattgacgcaaattcctgcaaaccttgctgcagcttttgggactacaactatgccagatcctacagatgcaagttggtacatggacacgggcgcgacaactcacctcaccgcgcagccaggtaccctccattccctttttaattcgagctcatccccatcggttgtcgtcggtaatggatcttctgttccaactaaagccatcggttattcatttttgccttctaaaatacgacctctccatcttcataatgtgcttgtttgtccttctataatcaaaaatctcgtttctgtacgtcaatttactaaagataattatgtatctgtggaatttgatccatttggtttttctattaaggatttcaatacttggacgaatcttctccgatgtaacagtgatggtcctctctactccatcacgtcgccaccattatcatcatcatcatcgtcatcacctccacaagtcatggtagcaacggttcccgattcttcattgtggcaccgtcgtcttggccatttgggaaacacaactcttcaatctcttatttcttctcgcttaattaagagtttgtttgccaactagtacgtttacagaacataattatgaaactagtacacttactatttacaatatgaaatgtactacaggtggttattgttggcttttttgttaccccggttctgacactacgatttccatgtaattacagagttgccagtgaaaccaaaaaaaagaggtttcttctcgactcttcatatttctggtttcttaaggaagttgagagaagttggtttctgtattatgaagaatatctgcaatgacgaagaagaagtcgagtaaatcgaagacaataagccctccagtggtaatgaaacaagaacccaagcggcgaaactccagagcagatgcacagagaggtaagtcgttatactgatgacggttcctcaagcaattttcgggataatttatgggttaataggggttcataattaggtttctgggttatttgtagatacgcatgcaaaatctccggctaaatctccagcgagtgctcgagggttaagagacgagtctccaatttcaccagcgccggcgaaaattccggcaaaatctggaggattaagaaacgaatctaaacaaggtaaacaaactcttatttgttgtcccttgccggtgaatttgatgaatccgactctatcatcaccgaacattttttttgatttggtttttttctgagatgaataataggagatgagagatgcagagatagtgaatttacaaacccgagcctcccttgccgtttgctgcatccatcggagttcccggatgggggacgccttaacatacactcaaagccggagtatttgggaactctggtggaattactagagggttcagaggcgtgggatgagcttattgcgtcccaattcaaaaaattgtttgaacttccagttgctaggtgtcatcactctgcaaaactcattcatgggatgcttacaagacagcttctaacgaagaacaaacatgaattgtggacagtgtatggagggttcccactccggttctctatacgagaattccaaatgaccacagggctgatttgtgataagcttccatctgaatctaaggtagaagattaccacgacccagcatacctgtctgtttggaaccggctgtttggtgcgaaaagtatagtcacggtaatggatgtgatagatatgctaagggaggatgctaaagcggagactcggaagcgattctcaacatggaagaagctgagtcttgcattggtagtgctgattgatgggttgttgtatgcagcaataggaaacaacatcgggttacacgagactttgtagaaatgctgcatgatatagaattcttcttgtcttacccatgggggcgagtttcttttgaatcaacaatggaacggtttggcccttctgctggagaagaagatccaattgcggagctgaaggcccggctgtctcagaaaagcagtgtctgttatgggttccctcttgcactccagctcctggtactcaagtccgttcctgccctatgcagtaggataaaagacactgttgacttcagaaattttatccaaaagctttttgttgaccttggtcgcacaattcttctgcgggaatcagatgttcttgacgctgagcaaactgctaatgtaagtaatgttgactattggcttttattctaacattatagcgactgttttgaacttattgatttagggaattgtacagaacaccttaaatccaaaagatgcatcaatagtaagctaatgtgcttttcttttaatcatgtagctgtctgtggaatatacactatatcagtcagaaactgtgaagggggatctgtcgtggccggatgaaaaagaggatgaaggggtggagttgataatctctctgatcaagcagaagcaccacttcaaggctgaaacatggcccatacacagcatacaatgctcttccaaagatgctccagcagcagacgccgagtatgttggcgtagcgcttgatactgatgatgtagagttcgtagggacacgaactgttgggccagaagacaaatgtgaaccaagtaaagctgtgaaacgggcaaagaaagaatactaccccatccgtcgcaagcctttcacgcgttcaagtaagaaagaaggattgaatgttgaacccctgcctactcaggataaagctgctacacccgttggaaagactgtccataaaaagacagcaaagcaagatgcaacgctgatcaagcaagctcctcttctcagtttgttactcatggtgaattggctgaatgaagaaatggtttactcaacaacttgaagacctccgctacaacataagtaaggatcttttgaaaaatttgaaggagaaggccaccgaaactgctgcaggggctcctgagacccctaaatcgaaaagcaagaagaagaaggagacaaagcaacctgttacacggaaaaggaaaagagaggaggttacttctttatcttctggaagctcatcctcggggctgaaccatggaccagctgtggacactgacataggtgtagatggtggaggaactgtaaatctagaaggctctgttgatccatgggaactttatggatcaacaaaaaatatttcagaggtaatacttacatatacgaaagcaaaacatggttttatgtagatttttgcttatttaattatgcaattctccatgatgatacttttatgttgggactttatagaagatagctacagagatccttacatctccccttctaaaagacgggctaaatgaggaagaatgagaaacagcccagaatgaaaaatgtgcagaggtattaatttcgcgagcacatgttgctgcttgtgtgttaaccataaagctaacccttttggtttattgttattgcataactttttttttttttttgtaagccacaagaaatgggaagagagagccctacttcgccagtgccaaccgccacgcaagacaagcctatggacaccaagccaataaagactatggaagaaccattggatttgggaaatcgagctgggtcgccaaggcaaacaccttgttcaccagtaacacctattgctcaggtctagattgcgagtaataaattacatacacaatctgagatacaaatattttacctagcttgtatgttttgatcccaggttatacccgactcttctattgttgctgtttcacctgcttattttgagaaggagagaaccaatatacgccagccagtgccgggtaagcgtgttccaatacgttcttgcttcctcgacacaactaagtatagcgtagatcctaggatcagtgctctgtttaagagcagaaccaaggaacctgcatacacacctctcccaaagttggatgatggagagttccagacatttaaaaggctgcttgaagatgatccacagaggtttgatccttgttaatctcagttttattagaaaaagacacaatgttttttaaatctaacatccaagctaaacagcgagtacactatctgcactgggcacacagtgactaacaaccacttcttggacattgcaacgaaggagacatgggtaaacactgaggtattatgagcaaaaactaataatatttcatgcgttcgtagctaaaatgggtttggtgacatgacttactctattatgagttgcagcatatgcagctaattacaggaatgctgatgaaacgccggggtaaagcatacagtcaaagaagggtggcaatcattgatacatggtttgcaatgcttctgtccacacactatgaagatttccagaaatgcgaggacaaggcaaagtacgaatgggggaaaacaatcaagggatacataacagggaagtcgactgggatacacatgaaatcggaattcctgaaacatgttgatgttgtctacgttccaatgaactgggggtgctctcactgggttggattggtgataaacttgaagcaacaaagcatagatgttctagactcgttcatctccccaactccagaagaagcagtcgaattccaaatgaccccaatcgtcagtagctgcccaactctcaccactgagatgacgactgagcctttcagctgtacacgggtaacaggactgtacgacaacaaaggcgatggagactgtgggcctgtggcatgcaagttccttgaaatgcatgctcatggaatggattacactgacatgacggctctaacggatgaagtggtgattaggattcagaaggtttatgcgatggatacatatgctgcttttgttgaatgggaggacgagtactagttatttgttcctaaacttagagtttgggtgtttctaaacttattcggggcttatgacttaagacttatatttaggacttgagatcgaagtatgcatttgtatatttattagatttgaacttatgcttatgacttaaaaaatcgaaagaatgttttttgtatattatttgatgtcaaagaattaatatgacttataacttattattttgtatatacccacggtgtacagattgcttctgtacaccgtgtaaggtgtacggattgttttctgtacagcatacatagtgtactataagaatagcatacatagtgtactataagaacagtgtacgaatgggtatttgtacagcatacatattatttgaattaattattaaagaactaattattgtttgaattaattattaaagaactaattattgtggcgtactggaagagaacatatattgtttgaattaattattaaagaactaattattgttttttaagaacttagttgttgatatttaatgtgtctgaacggcagatgcggtgtacacattggagactgtacatatattaagatgtacagattgttctgtagatcgtctgtggtgtacggattgttatctgtacagtgaattgggtgtacggctattatctgtacagtgaattgggtgtacggactgttatgattcatctacataggttattgttggcttgtgattttacatatggtttctgtatcgtatataaagcatacggatttgttcttatatttcaatgtacagatttgttctgtacagcgcctgtggtgtacggatgtttcattagtacaatagtccagataggtttaggttaaagtatgaaagttagttttgtttttgtttcctataaatatgtccttagtggttcgtttactcatccacacctcattttctttgctcctttttaacttcataaacctcaaaagtaatgtctttataagatttactagatgatatcttccatattattgtgaagaagctgggagatgatgacgcatattacctagctccggtgatactcacaaacaaacgaggaagggacattgcactctcgagggacattgtaaagtcagcaaatctaactgctttctgtctcgagccaccgaaaatatatcctggtggtgtagctagaagcttctttacacgtcaggctctttattatgaagctttgcgtttagtgacccgtgaaagggatatacaaggttcccttgctttgctaaatgaactagttcctgaagatgaatcggcgactgtggcctatgccatgttccaaatgtgtgctgaaaggggtgatctagccggggctacattcgacatgatattcgagagcttaggtgataggcttttgtttaatatttactctgaagatttggaagcagaatgtgaaggtttgattgacacactattggcgtatgaaccagctaatgaagataccttcggtccaatctgggagtttgcttactctaagagaataaatgtaccagactgtgcttattggcatgaaggcgaacattactgtgaaggatgttacatcttcaatgcagcacttcgaatttgtgaaattctgtagagatacaaacaatgagaataacttctgaagaaatattttaatatctatttgcagttattgtagaattatgtttcaaattgtctaattagtaagaacgtaacttgaagtacctagtagaagtttagtgttaatgtaaaattccgcttgaaaatgtataaatgtttgtgtaatattaatgtaaattaccgctggatgtaatataaatgtaaaattgaggttgaaatgtctggtttttatagataatttatttcggtcaggggtaaatgatttctcaagattttgtgctctcaaaagcaccaacttagcggtgaggcaaattagtggcagtccgcttggggctttggaaacaaagtaattattagtgtggaagaacctctttttgtcaaatcttgaaatggtgagaagatagatatatgtttggttttatatattactgaaaagataattattagtgtcagaatgagtaagactaagcactaactataataataaatttaaactacatgtctaatcatttgggcatccaagaaatgcaagtggaaagtgtagcctgaagtgtcaatcatattggtaattatgagttctcacctcctcactacataaacgaaacatatccaaaccttgttcatctctaaatattaatgaatatattaataagcatttgaaaaaaatctcggtatgcgaattctggtaaaaatagtctcaacacaaattgaaatggtgagaaaataatgatatgattgcgtttataatttattcaaaaacaaattataagtatcagtaggagaaagactcaccactagccatagacatatatttaaaatacatgtccaatcatttatgcatccaaggaaatgcaagtggaaggtgtgtgctgaagttccaatcatatcattaacatatcagttctttggttattgacacatattaaaaacttgttcatctgtggagaagaaaagagttaggaacatcatagaaaaatttattttaaagaacgtaaagcaaaactggtgaaacggcgcgaggttttatagtgtaaatggcgggtagtttcaaagtgaccaaaaatgtgattattaactgtaacgccatacgttatgtttctgaaactaattcaagtgaaagacaatctttctaaatatatactatacttacacacggcataaataaaggtcatgacaaactttcgaaaaataagaacatatatataaataatacataaacaaagattatacatccaggagtgcgaaaacaacttaaaacaataattaaacaacatagtaagataatagctgaagaactataattatatagcaaaaagcaaaaacaaattacatccgcatagtcataatataatttaaacattgatcaatatggaaaaataaggagaataccttcagaccatttgacagaccttccttgacaaccaccataagtaacaatcgttgcaaaagttctcataaccgcttgaagcaagagcacaatccatggcacaatccggcgacgggatccctttgcaaagtggatagatgaacgccttccggtaagaagcgtggcttatcctccgatatggtcgtaaatctctgaccaactcctctccccatagcctaaccctttgtgtacttaagggagcgtggaaaatcccaaactgctctagatagtggaccgccatagcctcattcccaagacacatggagcgccatcctctgggaccagctgagctagaagttcaatacccccattgaggtcacaaccttcagccaccacccttagcccttcatagtagatggcagttttgttgccagctttgaggcatctctcaaagaaaggacggtacctcccttgatgcacgacgtcggtatcctggttccggaaatagtacaaatcgcttggatcagaacagagagagtagatgcaagcatcctttaaaacgttatctctgtacaccatatctcttccccttcggccagccttcaagataggacctagcaaccaccaacgatcatcagccacgagcttgacgatcttagccaacagatcgtcagggatgtcaggcatttctgttctcatttttttgtggataatctttgagaggaaacaaagacaagttttcttcttctacgatgttattgcaggttgattaaatatataagccacaataaagtagtggttgggaaagttacagttgagaataattacatcctcaaaccaaaacatattaatgacatgatgcctactctttaaaattacccactaatagtaaaaattaaactgtacagcgaaatctgtacaccgatttcggtacaccaccgtcagtacgctgcagtcggtagagtgcaacaaaatttaaacgaaaatacatgaccaataaggctaggaaggtatcaagtcatcagtagtacatgccactttgaaagaaaattagacaatatgcataaccttgatgtacatcgctatctgtgcaccgctatctgtacatcgctatctgtacaccgctctctgtacaacccaatctgtacagcattatctgtacgccgctttctgtacagcacaaactgtaaagctgtttgtacagcgaaatctgtacaccactttcagtacaccaccataagtacgctgcaatcactagagtgcaacaaattataaacaaaaatacatgaccaataaggctacaaaaatgcagtaaatgtggtatgcagtgatcagtagtacaagccactttggaagaaaattagacaatatgcataaccctatgtgtatatcgctatcagtacaccgctatatgtatatcgctatctgtacaccgctatctgtacagcacaatctgtacaccactatctgtacatcgctatatgtacagcacaatctgtagaccactatctgtacggctacaacgcaatctgtacgcttattaagtgtgcggcgatatctgtacgctgtataaactgtacggttatatctgtacggtgaaaaaggtatacgggggatctctgtacgttgtataaactgtacaacgttatctgtatacctaaatgagataaacgattggtgaagatgtgaaaacaactgattgaactgaaatacctcgccagatgctacttgaataatacacaaaaagtagtatctattcatcagtaatacttgcaacttcaaaagaagtttaggaattagacattgttgttaaaacatattgggtaaaaatgtctaccccgataccaaaaacaaaaacaacaccgaaaaaagctccttcattaataacaaaaaactagccaaatctttctaagtttaaatagcatcatccaaggggggtcttgcacgtaacacgattgtgacctaatcccccacatcgtccacctttgttaggcgttttggacttgttatttccctacatgcaaaagaaaaaggattgttgcctttggattatatagaaatatattgatgaaaaagatgtaactgacctcatattccccaaccgaatgaatccgcaacttaggaggtctcccagcaggtctttttgttttgggaggcattaaacacagtgaccttatttcctcagggactttaacctccgatggatcgcgtacaaggaggattggagcttggaccgttggtgaccacattgggagcctatgcatctctccaaccaaagttctgaactccaaacccctatcatgacacgcagccattgcgtgtgtacatgggattctaattgcttgaaactccaagcaagagcaagactgctgttctaaagagacgtggaactgctcaccgtcctttgcaacaacttcaaaatcccaactgccaactgccgaaacagacatccccaaagcacctttaaaccgcttcataagttccctttcaacagcaatgggtatgtcgccaaccgttctagatatttttttcctcctagattcaaaccacctagcaagcattttcctaatgaattcaagcaatgcaacaacggggcttcccctagctggtagtaacgcattgttcaaagactccgcaatgttactagacatcaaattatatctctctcccgtaaaatgaaccctactccaattcgcaacacccgatccttcaatgtaattccaacaagacatattccttttttttttatcctgtcacgaacattattaaaatctttgagacggaatgcgttaccagcttgccacactagagctgaaggccactcttctttccataccttcctttaacattccttctgatgtggaccaaacaagctccatggtgtgcttgagggaacacaagaccaacggatttgaatattgattgattccggtctgagacaaatgtcaagtcagggccatcttttattatttctgagagcttattcatgaaccatgtccaagaatgatctgtctcgctgtccactacggcaaaggcgattggaaaaatctgaaagtttgcatcctggcaacttgcggtaagaagacagccaagatacttaccaaagaggtgtgtaccatcaacgacaacaaccctccgaatatatttcaacctttttacactagcccccaatgagaggaaaacatacttgaatcggtcatccccaatatcatccaactctgtttccaaatgataaactgtgccagggtttgcaagttgtaagacatgaagataaaccggcaataaagagaaagagctctcatcagtgccttgagctgtctcaacagccaattctttggctttccaacatttccagtacgtcatccgaacattgtgctccctaagaagagagtcgggtaaatctcttgctcttggaccacagaaggccttggcatacttagcccttaggagagcagctacaaccttggacgtagcatgttttgaaaagcggctcctagtctgaaccttacacacatgttccaactttgccagcctcacttcatattcttcgctgtcacctccaacttggtgtgctctaactctccaatcacagttttttttgtcataacattcagcaaccaagtaatgtttctcatacctagtaaatttaaagcggaaaatacggttaatggcataaatggacagggcaatcctgaaatcttccctcgatgcaaaggtccttccaacaaacatattgtcatcctcttttgtcaaatcaacgtaagctgcttttgcatcaatatcatcgtccccaaacatcggctcgagatcttcgtacccatacacttgatcaatgcttatacctttctgacaagtttccaaaaactctgtcatagcaccagggttggtattttgaagcaaaactttctttttggggggctgctcaatgaaatcatcatccccgatgtcttcatgtacaacaatctctttatcagattggagagtgttttcgtggagggtatcgtcgtcgaactcagaaacttctaagtcactacctgtactaagagaggaagattcgtcagattctgctaaagactctgaatcatcacctgaatcaggtacttctgccggtagggatgtatccacccctgcagcggtgacaaaagctccagacttctccactgcttctagggcttctaacagaagttcatcgctgatgtcccattgactggataaatcacaaacggttgtactctgaacaaaatcagagtgattgttggggggatgggcatccatattatcttgaacagaagataataaccccgcaaagtaacctcctccaaccgccggaacaggtttatctctaaactgtacaatgcctgcaaatgttggttctccagcttcaaaatacttaacaacacttgcgctagtctgtctaggttcgcaggcaggaccgacgataactgaatcgccttctctaaaacacacaaacagattcacagatttatcaccaatacttagagatttaaagcatctaaactgccaatcagacccaatcattgtcggacccggcagaacaccagctaacagagctagtctgtcctcgaagatgtagctaagctccaaagatatggaaggtttctccagcccgaagatgtgacgaaccttaagctccaaatcccttaaagttcttaaccccatcaagctcatcgccctaccgtgacgacaagaatcaagcttgaattcccattcaccagtgctatacaaaatccatctacctgcctgtacaacgacaatatcatccactgcaaaaaaggaattcactttttatcagtctgaaggcttttaaacattatgaggacaagtttacaaaacaattttctgatcagaattccaccttccatggtagaaacgcaaagatgaattttcccggtaacaaagaaacacaaccgaaactgacaatcatcatctccttttgttacttaaaaataacctaatcctcaaaaaaacgagctcaaattccccccaaaaatttagctactttcgagaaaaacctaaagagaatttgattattataaaattttattcaccgacttgttaactaattccgttgatttgaaacattcataaatgcagttgtttctctcagctcgcactccggcattgaataagccgacgataaagaagttgacttcaacgccttcgctacgaattataaatctgtaaacagactttgattaaggcccatctagaaatacgctaggcccatgacgtttgttgtatcttgtaaagcaaacccccgaactcagtcaaagggtttcctgcaaacgaacaaaacaaacggcgacccctaaacgtaatttcctcaaacgaatcatggcccatgtttttctgtattacaagcgacgcgtattacagtcgatagtggacccgattatttccttaattataaatagtgagtgtactacttccataattttgtttcataaacgtactaaatctcaacttattcccttaattaattgttctaaaattgacatgtctctttgtcatgcatgtcaattggggaaacacactagattaccatttgattcagttatttcttctatttctgcaccttttgaaattattcattccgatgtatggacctcaccggttcctagcatcagtggaataaaatattacgttatatatcttgatcatttcactcactttctctgggtttttcctcttcgtaaaaaatctgaagtgttttccactttcttaaagtttatggcttacgtgtaatttggctgcagcattaaatcattacaatgtgataatggtggtgaataccaaaacagacaattccttaatcacttagccactcatggaattatccctcgcttctcttgcccatacacctcgcagcaaaacggcaaagccgaacgcactcttcggacactgaataattctgtccgttccttactcatccaagcaaacatgcccaccacctattgggttgaggcacttatgatggcaactcatctcttcaacattctcccctcatctaccattcaaaacgaggtacctttcaccaaacttttccacaaaccggccatatacaatcatcttcgagtatttggatgtctttgttaccccaatcttcttccggtttcgtctcataaactcgatcctcgctccactgcgtgcgtttttcttggatacccatctaaccataaaggatatcggtgtctagaactcgcaacccgtaaggtaatcatttcacgtcatgttaccttcgatgaatctaaatttcctttctctaaatctatctcagaatctccttcaatcatagatgaaccacaacttccggtgtctatttctcctctccttcgccaaattgatccacctcaaacaattcccaatgaaccaactccacaagtagctcctccgcagcctccaaccgtcgttgcgcactctatgagaacgcgaagtaaaaacggtattaccaaacccaaacaaccattatctcttcacactgacattatttctcctcttcctacctctcacctaaaagccttagaagatcctaactggaacgcagccatgaatgaggaatatgcagctcaaattaaaaagggaacgtgggacttagtaccacggccccgagatactaacattgtgcgttccatgtggttatttaggcataagtttggtcccgatggcaaactatataggtacaaggcgcgacttgttgcaaatgggaaatcacaagaaataggcattgattgcgacgagactttcagccctgtagtcaagccggccacgatccgcctcgtattggaactatccctctctcgcaaatggccaattcaccaactcaacgtaaaaaatgccttcctcaatggcacactcgaagaacccgtgtatatgcatcaaccttcgggattccgtgatcccaccaaacccgaccacgcatgcttactcaaacggtcactttacggtcttaagcagtcaccacgagcctggaatcaacgatttacccaatacgcgtgtcgaatcggttttgtgcaaagcaaggctgacccatcgctttttgtctaccatcgcgccaatggaacagcctatcttctcctatatgtggacaacattggcctcaccgcatcttcaactaagcttctccaagatatcatttcatctctaagccaagaatttggaatgacagattcaggagaacttcactacttcctcggaatcgccatcaaaagaaactcctctggattatttctcaatcaacataactacgccgccgatatactacaccgggccaatatgacaaactgtaagccatccaccacaccagctgattcacgagtcaagctagcagctaacgatggaccagcagtcgaagatccaatactctaccgcagccttgccggcgcacttcaatacttgacatttacacggccagatatctcgttcgctgttcaacaagtctgtctattcatgcacgacccaagagaacctcaccttaatgccctcaaacatatccttcgttatctaaaaggtacactcaattatggtttgcagctttatccatcagatacttccgggttaatcgcatacacagatgcagattgggcaggctgcccaacaacaaggcgttccacttccggttactgcatttttcacggtaacaacttgatatcttggtcttcaaagcgacaacatacagtctctcgctcaagcgctgaagctgaataccgtggcgtagcaaatgcagttgctgaaataacatggctcagcaatctcttacttgaattacattgtcctctctccaaggccactttggtgtattgcgataacatcagcgcagtctacctctccaccaatcctgtccaacaccaacgcaccaaacatgtagagatagacctccacttcgttcgagaacgcatagctatgggtaccgttcgtgttttccatgttcactgttctcatcaatatgcagacatctttacaaaagggcttcccactcctttgttcacagagtttcgatccagccttagcatcatccaaaacgacgctaagactgtgggggagtgatagacaagggaatacgtattattcacttgccatatgtgaattgatattacttggagaacattcttgtatatgtgtatatattgtataaccaatgaatagagaaaggagaaagggcatcgagatttctaagtaacattctcgcggttgttatcttttccaaaaactatgcttcttcatgctggtacttgaatgaattgctggagattgttaaatgcaaagaagaaatcaagcgattggtggtcattctgttttttttaaggtttggatcattctcatgttaggaaacagaccggagatttgggaaaaatatttgagaagacttgtaagaacatgaacagaggatgagataaatctgtggagaacagctttggttgatgtagcttaatattcttggatattattttgtgaattggtacgttaacttgatttgactattcatactcgttgtgtgttgagcttgctttgtgtgttgaacttggttttatgtattgatttgtttcttgttgttagggttaatgaagcaaaaatgatagaagaaattgcaaatgatgttttgcttaaaccgaatttaactccatccaaggatgttgaggattttgttggtattgaagatcatataacagagatgagttcattgttgagcttagaatatgaggaagtgagaggatggttgggatttggggttcctccggaattgggaagactaccattgcaagagctttatttagtcgtctatctcgtcatttccaagctagcgtctttatagatggtgcttttgtatctaagtgtaggaagaattaccataaagccaatccatatgactataacatgaagttgcatttgcaaggaactttcttgtgtgagatttttgggaaaacggatataaagatggatcatataggtgcaatgggacagaggctaaagcatcataaacttcgtactgttcttgatgattcggatgatcaagtgttgctagaggctgatataagatccaaagcttggtgataggaggtggagtcacgggaagcaacaagatggtggtcgctctctcttgttgtttgatggatgaatgctgagatagatatgggatcaaacaagctggcgatagccctctctcggtggatcgattgatggttttgatggtggatcgagaactgctactttgtgatgagatcacgaatctagaccttagtgaatccacacaaaggacatatactcacacgtttagtaagtaaataaatccacctaacttagataaacaaaaacatagcctaggctttagaaacaattttcttttatattccaaaaatctatatatttacaatgaatggataaatgaacttatatagggctcaatatacaaatcatcaacataaatgtaaaaataaatcaaattaattatataatcattcaacaattattttgagagattttatcaatcatcattgatggagattggttctttgtatctatacactttcttgatatatccatgaattgattatcttctagaaacttccttctaatttgatcttgatttgccttgaacgatttcttgagacatggatgttaaccatattttcgagactgcgtaacaggccttggctggtcgaactcaaaagtttggacatgggagtagaatcattgcgattacaaaatataagcatattttaagagttcatgggattaaaaaagggagatttgcaaaaataactttcttctagtgttcttttgcaaaaataacctttcctgttggacatttttaaaattgccccttctcttgcggaaaatgactacgttaccctgaaagattaggtttttcttcttctcttctcttcgacacacaatttcttcttctccgacggcgatttcctatttgaagatccgacgaagaaatcgccagatccggtgaagaaactttttgccaaagattctatggtaaatatgattctcaattgtgcaatttctagtggattaccttaacaattaatcattttgcaaatcaccctaaatcttatagtttagatctcgattttgatttattttgtatattgtttcacacatggactgagagagctaaatcaataaactgaatcaagctaaactaaaaaataaactgaatcaagctaaacactaaatcgaaaccaaaatctatcacaaaatagtataacgaattcacataatcaacaccaaaatcgaataattcaattcgaaattgagacatttaggctaaaataacaaattcgaaatcgattccataagagaaacacaaacctgggaaattgatggtgaaatgaagactgcgagggtgaaagacaagacgattccgacgacgccgtcgtactctccgacggcgacagaccaagaacaagagagacaaatgaaaattaggccgctggtctgtagttcactataggtaaaagggggatacaaattaggagagagtgcaaatgaaaatggccagaaaaagaggttgattttaaaaggggtatgatgaaaagggtattagagaattaattaaaaaacaacaaacaccaataattagtcaaatcggaaattaacattacatcataataataattagtattatattttaaattaatattatatcatttttgataattaatgttatttgatgtgggatgcatgtcacttgttctgattttattataataaattagatccatcattgtttaaaaaattaatttagtagttaatatgttattatatttgactttttctagaaatcataaaataaatttatctatctaacaattttcattattcatgagtttagattacatattaatattattctaaattaatataaggctaattacagttatactagttttacaagtgacaagtttttttccacaagtttactagttgccgtatattcaaaatatagttatactaaagatagtatttgtaccaaagtttcacataacatcttcaaacagaaagaaacgattttaaataaataaagctatcatttccataatacaacactattgttttatataaaacacttttcatagtatatagtataaggaacattttgtacgttgtcatctcttttgatgagctgactatgtgtatgagctgaatagagtatggacgttaatcgagaagcctcatgtaaccaatttaacaaagagcaaggatgacgctacattagagaccaaattactgttttttcatcttggaaaccttgtagagatgatactctcctatgaagtgtggcgatcgccacgaccacccaattcgttttttttgtgaagttctagaacaagagggcctaaaagcaaccagtgaagttcaaaatacagaaatgagagtagagttcagatcattcctgtctacaaagtaatgttgctaggagcagcgaatccagagtggttcatctctaaaccgacttcaccactagaggagcaatctttgttggaaatacaagctgaagagataggtgagaggcagtttgtatcaacagtcgaggagtctgatgtgttctttatcggtaagaagaaggttgctggtgcagggtcaacagaagctaaggtactcttccatagctttcatttccttctactttgaggacaaagtacttcttcaaagagggagtaatgatacgtacccaaataaagttattgggccttgttatcttgttattgggttgctattgtattagcatcttaagccttttaatttctggatttagtactctttcgcttacgagaaaggtggtcgaaagatcaattaaaaaatcgacaatcatcttcttcctcaatttcttctgatttttcatctctttcttctacttctcacctaatttatgttactttcttgatagaactgaatcgggttctatcaggtgacatccctagaagcgattttagttttatgatactataaattgttgtagtatcgcttttgaagatttgtgcgtctgtgtctcttaaattgaattggtaaaaaatcatcaaggcttttttttggtaaatgggtattaatcacagatttgaataacaagttctatgcaagagcatgttttaaaagtctgcattagaagaaggcacttggtaatgaattgattatatatggaatgtccttgtatgtatcttcgcctagctagtacctaaatcctctgtatacgttttataagtataccaaacttccttttttcagttcctttcagccaatccctattacgaaagataatgcgacttatttgtgttagttatacagacaaacctaatgcatactggacatggtaatttacgtgcagaccagcttttaagaaatatgtgagggatttaagtggttattatctggtatgggatcaattacaaaaaactccctttttctttatgcctttgctacaagcacacattttcaatgtattaaccggaataggcatttttattccactaaaaggacatagttgtccttaatcacctaaaccagttttaatctacttaaattcatcaaccgtacgtgtcttctctctccttgcgtttctcgatggagcatacacggcggagattttacacggctttggaattgtgatttccttagatgaacaacaccatctctgctaatcgatcaatcctataattttctttcttctcgttcgaaactccggccaagcgtttcatgtatctccgatctgattctaaagcttaaatgaaaaatgcagtttgaacccaaaccgaacatcctttgaaagtaatttccccttttaatctcccatgttacaaaccaaagaccattacttttctgaagcttcaatgaaaagtgattttcctttagtttagaatgttgatgaattggagattaattgttccgatttgtgtctaagactagaacccttgggttctctaggcattgtctctggtttagattcctttaaacaaaactcgtttaatttgattcattggatattagaggagattggtggaggaaaagtttgtgaatcgttggaggcgaaggagagtgatattgatgaatttgaaagtattgatgttgatggagagtggattaggtgtttctaaagcaagttccgacggtggaaagcgagaactctgttgcgctacgaagaaaacgatgaagtggtgctggtctgtcatattggactcgtttcttctgtggattcgtttcaagtctgggtatctcaagaagaaagattgaagtgttcaaaaggttttctaattgtcttcataacctttcgattcgtttcaagtttggtttctaaagaagaaagattgaggtgattaaaaaggtttcctgggtgtttcagtgtttacagggttttagtttaatcaagaaaaaggatatgaatatggatctgaacaaagctatacaagagttgtcaatttcagatgataaacctcttgttcatccaaatcaagctaagttatgttcttctgaaaagaatcattgcagtcttatgggtaggttcttgaatcctagtaatcaaaggatgtctaattggattttagacatgcctagaatttggagattaaataatagagtctatgaagtggctttatctcaagaaaggtttcagtttattttcaaatcagaagatgatttacttgaaatcttaaagacaggagtttggacaaaagatgactggtgtgtgctcatggataaatgtattgaaaggcctcaggctgattacctaatgtttcttccaacttagatttgcctccgtaatattccggtcaattattacacagaggaaacaattaaggaaactgataagtgtgaaggtaaggttttacaggtgcttttgacccttaaacgtcacatgctcaagattatgttcgagtgaaagttctacttgatgtcgatcgacactgggtccggactgcaccatatgaggtgagaatcccgatgcagcctgagtctgcctatgcccccctatcccttatccgaggaagcgtcgatctaagcaggagattcatgctactaagtgcacagccatcatggagaagatcctcacttctcttcctaagaatgtttctgagacatcttctgctccactcaataggtatgtcaagcaacttgttgacaatggtattagctcagatgaagctaaattgctgacaagggacatcagtgcaatcatgctgcctaaggttaagaaagagaaggcacaaagagtggacattgctgagtacatccgcaccatcactcttgatcagaccactgagaagctcccggatccaggtagctttgtacttgattgctctatctccacaagcaggttcagccgctctttgtgtgacatggtatcaagtatcaacctcatgcctaagtctgttgcagagagattaggcatgactaactacatgccgactagaatcactctcctctttgcggatcgttccaaatgcatccctgaaggaatccttgaggatgttcctgttaaggtttgtaactccttaatccctgctgattttgtggtcctggactacgataaggaacccaaggatcctcttacccttggaagagcattcccaactatagttggtgttaggattgatgtgaagaaaggtaggatctctctcaaagtttgtgatttggagatggagtttggcatggatggttcagagttcactaagactatcaatatcattgcctctagcacagaaacacctcctcggactgcgtagaatccccagccagagccataaacaacgctcccatcagctcagctcgccaatgagagttgcagagcaacagtgtcgatcgacaccatccctcctattgatcgacaccctcgggattcacagacagagaatactgcacattctcttcagcccacacctcttgcggccctctgtgataagttctcttctatcttttctcctgcttacccatcgattaattctttagattcttcgaagtctgcttcacgagataacaagcctagagttcttcgaaagtttctttctcctgttgttcttgcaggaaacgaggagagtgtcgatcgacatcaccatgagtgtcgatcgacacttgcagctgccccgaccagatcagtttacgcaccgccttggaaggcgagaaggcagcaacaatcttccattatcccaccacatcctgaactccgccaagtcaagctattgactcaaaacaagcgcttagtgggaggcaacccactgatttgatttttcttttcctttcttttattttctttatttttgattcatttttcccgccttcttcggatttgaatgccactggagacagtgccattttagtcagggagaggttcttactaatattgcttttatttatgattcctattatttttttgtttttgagtttattgagtctcccttaaaaaaaaaaaaaaaaactgttttttttagtttagttaggaatcatgatctatatttctcttgattattgcctggttgatgagtgctgcaggttcgactcaatccgactattggaaaatctagatggcaaaccaacagacttgaggatatcctagtttccaacacaaccactaaggctggagctaatctcactgatcttccttttacctcttcgaacggttagtattcatagatcttgactccttgtttatacctgatattgagacccatgtgataaagaaaaagtgttcctctccccttataaaaagaaaaagaaatgagagattgataggattttcagatactgtatagaggtaggaatgtttcctatgaccccattattatacattatttggaatgatcaattacaaagtttagaaaaataccgagggtgtcgatccagtatgcgagttcccttttgtttactctctaaaaagaataagtctcggagagagaaagaacaccaaagaaaaaaaaataataataaaagaatggtcgatttatcatggtatagtacatggatgagtctagaaggatcttgaatgttagattgtttgattagacccagcgatgaaagcctggtggatatagttgtggaacttaggttgggagttcctttgttttcaaaacctcttccacgggttcgacttttgtgttgtgcttgagggcaagcaaaagctaagtctgggggagtttatatatccctattttaattaattttatctatgttttagggttaggattttgagtctttatgttatttctcgagtctttttagtgtctttttaggtattctatgcaatgggacaacaatggagataaggagacattttagagaaaaagctaaggaaaaggaagctaagcatgattttcgatcgacaccagtttcggcccagcaaagtccatgacgctttcaagtttacagaagaagaaatttgccccagaagacttccctatttacattattagacccaggacgttttataaggtttttatatattgttttagacctaagtttcttttatcaagttctttgcaaatccctattttcagagatataagctattcataccttgttcttgagagattcattcagttcttaatacagtgaagagatcccttctttcccctatcttatttgctgtgtttatgctttctatctcaattatgttgtttgtttcattcaatatgtctaagtagtttgcttgtttggaatagggtttcttattagggattcatatggtttagtagatcgccccctgttaagttatctgtagaatttttcatctttgattatacttaatgctagatctagagtaattaactagatattgaatccagacctaagttatacttaatgctagatcttgaatctgcagggcaaaacaaaagatagtttaaaatcaaggttggacttggctgaaatatgcagcagacctgagttgcatgttacacgagatggaaaattaccggtttgaaattccacttgtctcctgatgcaaagaaggagttgttctagtgggttgttgctgaagtgaagttcctagatggatatgtgtcaaaaatttcaagatgcgtgttggggtcggattccacctaggtaaccgagccgaccatgattaacgcctcggagatcttgttgaagaaccatcctgagtcgggcctcaaaacacctcggggatcatgtcgaggaaccatcccgaggcgacaacaagaacgcctcggagcatcaccacaaaggattcctcgacccggtcttgaagcgcctcggatgacaacccagaaagtcatcccgaggcgggtcttaagacgcctcgtgagcgcatcattcgactaacaaggttcgagccgctcaaccacaacctgagggtcagctcaacccggctcggaggaacatcgggtcgggacagaaccttcaagaaatgacttaaccaatatgagatcgaacataccatttccgaaaaacccagaagagatattagagaatctccgaggatatcaccaaatataggagttcccagaatcttcggaagataaagacaaatctccttcgccagctctaagataaggagaaatcttccgagaatatcgcgagaagcgatctgataacgccctatataaagaacttctgaggacaaagaaaaagacacgcacaaaaacgctctcaacttcaggctatcaaatacgccctgattttgaaggcaaaacacttattttcatatttctaaacacttgtacgatcgaatcctcattatttcaataatataaccaagaacaccgtccgcggtaatcaagctgttgttctgtgagaaactcacaaagatccattctttgaagaaacccttagtacaatttctcttgtgcgagtttcgactctcacaatttggcgctagaaggaggggattgagatttctcttacttccagaacacagaaccaaccaaccaatccacaatggtcaacattcgaatccccggtaacacagttgacgtagagggaaacccgatccctccaaaccaaacagacgttcctgaagccaccgctcccgcggtcctagcagaattgaggagcatgatggctcaacttcagaagaaagtaaacgatcaagaacaggcgaatcggtctttggcgcaacaactcgaagcagctacctcccaaggacagatcaggactactcgtttcggcgcaaggcatcttcacgatcaacgaacagcagcagatctcaatccaacatggctcgtgttacacacacctggcaacacgatgaggcctatccgccgaaccgcaccggaaattggaagagatcgagccgagccggcaatcttggggaatcgagacacgaatcgaacagaaggaaacgatccgcagctccctcctccctgagcagaaaatgtcgaggccaatcagatcggggtctcggacgatgaagattcaaaagagaacgttcgatgggctgaggagtacgccagagaacaggaaataagcgctatcaagctctccctagccaaggcagaaaacgagatgaagcttgtgagatcccaaatgcataacgcagtctcctcggccccgaacatcgatcgcatcctggaagagtcccacaacacacctttcacacgcacgatctccaacacaataatctcagatccaggaaagctaaggattgaatacttcagtgaatcctccgacccgaaaggacacttaaagtcattcataatctccgtggcccgagccaagttcagacccgacgaaagagacgccggtgtctttcaccttttcgtcgaacacttgaaaggaccagctttggattggttctcaagactcgagggaaattccgtggacagttttcaggagctatcgacgctcttcctaaagcaatattcgatgctaatcgatccacgtcagacgccgatctatggtcattatctcagcagccaaatgagccacttcgagacttcctcgcaaaattccgatctaccctagccaaagtcgaaggaatcaacgacgtagcagctctctctgctctgaagaaagcactgtgctacaagtccgaatttcggaaggagctaaacttgtccaagccgcagacaatcagagatgccctacaccgagcctcggattacgtttcccatgaagaagaaatggaactactatcaaaaagacatgaaccgcctaagcaaatgcctcgtagcgataaatcccaattcagatctccgaaccacaaaaagggcgctcaagacgggacattcattcaccatgaaggacgaaatttctctgaagcccacaattaccaagctgatacaccccgaggccgaggacgaggccgcggtcgaggacgcgggcgagaatcctacacttggacgaatgaccaacccgcaagaaacgagcaggaatactgtgagttacacaagagttacggccaccatacttccagatgtcgtagcctcggggcaaagttggcagcaaaattcctagtcggagaaatcggtggaggcttaaccataggggacttagaaacggagaaggcgaaaaccgagcaggtctatgctgtggccaatcccgagcaggcggcccccgcggcgaatctcgaaggatctaaaagaggttgaggcaatcgcgaagcagatgacgatgaaccagaagctgctcgaggaaggatcttcacaattttaggagattcggctttctgtcaagacacgacggcatcaatcaaagcttatcaaaggaaggccgactcaaatcataactggacgcggccatttagcggatcagatgacgaagtaacttttcatgaaagcgataccaacggtttggatcgtccgcacaacgatcctttagtcattacactaaccattggtgatttcaacgtcgaatgagttctggtcgacaccggaagcacactggacatcatttttctgacaaggctacgagaaataaagatcgacttgacgcaaattgtaccaactccgcgaccagaactggaccatcaagttaccagtccgagaaaccactatgactctcaggaccatcaagttaccagtccgagccaaaggggtaacaaaaattgtcgatttttctgttaccgaccagccgaccgtttacaacgcaatcatcggcacaccgtgattaaatcaattccgagttgtcgcttcgacatatcatctttgcttgaaatttcccacgagcagcggcgtgaaaaccatctggggaaaccagaaaaatgctcgaatctgcttcatggcagcacacaagctaaggaaccccgtcacaaagtcaacggccgacgcgaatcgtaagaaggctaagcttggtcgagccgaagagaaaacaatttccgagcaattatagcagttaaagatcggggaggctcgggaatccacaaaatcaatccccaatccggtaatctctatctgccttgacgatgaaaaacccgagcgatgcgtagaaattggcggagatctaggagaagaattaacagctgaactcaccgctttcctcagagaaaacgtcaatacattcgcctggtccccagaagattggcccggagtaagtgttgacatcgtattacacgagctcaacatcgacccaacgttcaaacctgttacgcagaagaggagaaaattgggtcgggagtgagcagaagccgtgaaagccgaaatagagaaattactaaggatcgactccatcaccgaggcaaaatatctcgattggctcgcgaacccggtcgtagtaaaaaagaaaaacggcaaatggagagtctgcgtagatttcaccgattttaacaaagcttgcccgaaagacagcttcccattaccgctcatcgatcgcctcgtagaatcaacttctggaaacaagttgctatcattcatggacgctttcgccggttacaaccagatcatgatgaaccccgaggatcaagaaaaaaccgcattctacacggaacaaggcatcttttgctaccgatcggactcaaaaacgctggggcaacttatcaacgcttcgtcaacaaaatcttcgcattacagatcaagaagacaatagaagtttacatgctggtgaaatccatggcagaggaagaacacgtgtcccatttgcgcgaatgtttccagcagctaaacctctacaacgtcaaactcaatccagccaagtgccgcttcagggtaagatccggagaattcctcgggtacctagtcacgcaccgcggcatcgaggcgaatccgaagcaaatcgaggcattattaggaatggcatcacctcagaacaagcgagaagtacagcgcctaaccgaaagagttgcggccctcaaccgtttcatctcacgctcaaccgacaaatgcttggccttttacgatgtgcttcggggaaacaagaaattcgaatggacgacccgatgcggagaagcttttcaggaactcaagaagtatctggcaacaccacctatcctcgcaaaacccgtaatcagagaaccactatacttgtatatcgccgtatcagataccgcagttagcggagtgttaatccgagaagacagaggcgaacagaaaccgatcttttacgtctcacagacattcaccggtgcggaatcttgctacccgcaaatggagaaactcgctttagcagtcataatgtcggctcggaaactgcgaccctactgtcaatcccattccatcatagtaatgggatccatgccgctccgcgccatcttacacagtccaagccaatcaggacgcctagctaaatgggcaatcaaactcagcgagtatgacatcgagtatcggaacaaaacatgtgcaaaatcccaggtcctagccgattttatcgtcaaactgccctttatggaggcccgggaaaatccactcgatacaacttggctattgcacgtagacggctcgtcatcaaagcaaagtttgggtgtaggcatccgcctcacttcgccaacgggagaggttctcgagcaatcatttagacttaacttcgaaggcaccaacaacgtggccgaataagaagcgctcgtagtcggacttaatttagctcgggggctaaagatagagaaaatccgagctttttgcgactcacagctcgtcgcgaatcagttcaacggagaatattcagatcgggacgaaagaatggaggcctacctgactcatgtacaaaatctggcaaagaatttctaggaattcgagttaacaaggatccctcgtggagagaatacatcggttgacgccctagccgctctagcctcgacatctgacccgagcctgagaagagtcatcccagtagatttcaatgaaaaaccaagcattgaccttgggaaagaggaacacgtcctcccaatacaaatcggcgcggatcaagacgacactccggaagacagcccagacgactgcaactcagaatggatagaacccatcaaaagctatatatccgaaggaaaattgccctcggaaactcaaagctcaggctgcacgtttcgttctagtagatgaaaaactctacaagtggcgattatccggacccttaatgacatgcgttgaaggagaagcggtttgcaagatcatgaaagaaattcacggtggctcgtgcggaaatcattccaggggaagagccttagccatcaaaataaaacgccacggattcttctggccgacaatgatcaaagactgcgaaaagttttcaaaacgatgcgaaaaatgtcaaaggcacgcgccaacaatccatcaaccagccgagctcttgtcatcaatcgcctcgccgtatccattcatgcggtggtcaatggatataattggacctatgcatccctcgaagcagaaaaagttagttctcgtcttgaccaattatttctccaagtagatagaggccgaatcttacgccagcataaaggacactcaaatcgagaacttcgtgtggaaacatatcctatgtcgccacaggataccttacgagatcgttacggataacggctcgcaatttatatcaacccgcttccaaggcttatgtgataaatggggaattcgacttagcaagtcaacaccgcgatattcccaaggaaacggccaagccgaggccgctaacaaaacgatcctcgatggcttgaaaaaatggctcgatgctaaaaagggctcgtggtccgacgaactcgagggtgttttatggtcgcatcggacaactcctcgccgagccacaagagaaacccctttcgtcttagtctacggaacggaatgcgtaattccagccgaaatgatagtaccgagcctacgtcggagtctatctcccgagaacaaccccgataatactcacaggctcctcgacgaactcgatctgatcgatgaacgaagagattcagccttggttcgcatacaaaactatcagaatgaaacggctcggcattacaactcacacgtccgacaacaaagattccatgaaggagatcgaattctccggaaagtttttcaaaataccgccgagccaaacgccaggaagctcgggacgaactgggaagggccatacttaatctctaaggtcatccgacccagagtatatgagctcgccaacttaagcggcaaagccgttctaagatccaggaacgcaatgcacctaaggaaatactacaactaaatccaaggtgactaaacttgaacaacgaggtggcttgatccttgaaaagggtacgtaggcagctcatcttcggacgagttcagctacccccccccccattaataagggggggagtgggtccgtatatccatactcccatttattattttgtataagtactaacttcggcataaaaaataaattcgattcacaacttttgaacgcttcggctaaatacgatgagcgatggctcgtagtatcttttacgcctgctcggctacagcgcgctatataaatatgagataaattctttcagattaattttaagaagaaatttctatcttcagaaacccggtcttacacaaacaccggtaccccagctcgtttctaaacgatggtgaaagggtgaatcggatcgggtcacaaccgagaagtttcacgcaaaatacttaaactgaatcatatcaggcaataaaacggttcgggttttgtttttagaatccaaccaagtatttcagattgcaaaatggataaagccgtccaggcataggttctacaaatcgttggataaagccatccaggcacaagtacaacaaaccgaacagattaacaaaaaaaaaaaaaaaaacgatgacaaaaaacggctctcgtgtcgtctacttagtcgagctcttcagacgggcgaatatcctcggcaggcagaagtgacccagactgatcggtgacccccgcctcgtcggcaagagtctcgaccgacctgtggccacccggacttaaaggagtggggtcgagagaaggagtcttgagttcctctttcagctcggcgataaaattggtgaaatcgacctcggcattggcgaagtctttcagccattcctcaacctggtccttctcggtcgccaacactccaccttcctcaagtgtcttgatcagttgcgcattagcccgcgcctgggataagtacataaactgaccgttgatcccgtcaaggagcgacaccttctgctcagcggccttaaggtctcgcgcctagccgtttgagaagcccgagccacttcgctatcgcggagccccctcgcctcggctagcatgcgtttgagacgaacgacctcggagtccgccctcaaattcagctcggccatcttaatggcattcgccttgttcacgaaggcctccttttcggcctcctccttcgccatctttgccgcggcagcttaggagagcgcctcatctctttctcgctcgacagcttggatccgagcatctgcatcggccaacctgttggccgcctccatgttattcctcatggccgaatcgtccgaatgcaccattcggttcatcgaggcgacaacctagagaacagagaaagaaaattacggatcggagctccagactgatgaaaaatgaaaaagttgaataggcacttacccgcaggaaatgggacaccgtttcagcatacttccgcgactccaaaagagtatccggaggagaaagcaaaggaccagcacacaccccgaggaggtttccagagactacccgatcttcaaaaatggggtgctcttttcccgccttggtactcgaggccttcttcttgctcttcttcttggacgatgaatcatccgtccgaacgcgcttactcgcaggtagcgcgacaatcgcctcgggcaaaggcgcaacagcagtaggatcgacctcatgagcctcagcaggcgtcgggtcaatcggggccacaacatcgggagcaacgtcccggtcatgagtcgcatcgggagaggccgcccgcggcgaaatcaatcccgcctctgcgaggcgcttctcatctgctcggaggcactcgaagaagatacatcatcatcttcaaaagacgtccaaaccgctctccgtttgtagatgggggaaggtcgtctggatgatttgagtcgctggaatcaacgagagaagcgctcgggatcgaaagagactgactggaactcatttttggctcagggacgatcgatgagatgagaaacgaccagaaaacaagaatttctaaaccgaaaaaatcaaaaataacaaaagaacggcggagcttcaccggaaaagaaagaacgatagaaatatcaagatcagagagaaggaagcaaacctcgtttattttcttcgaaaacttcaaatgaactcccgaaggaatggctcgtcgtatatatagagtttttggaggcgcgtcgggtccgcaacaaacaattaaaacgcgtttaagcgcgtgggctcgacagaaggaaacacccgcgtgatcctcgggaataagcgagaaacgttttccacttctcaaaaatagtcgtcggcacgcaacggaagtttgaccgtccgggaagatgaagcgacaaagttagatctaagaagatgaacagtcggctcgggaacccatccgtgaaactcatcggctttccgtcaagacaatgagctggggggcaaactgttggggtcggattccacctaggtaaccgagccgaccctgattaacgcctcggagatcttgtcgaagaaccatcctgagccgggactcaaaacacctcggggatcatgtcaaggaaccatctcgaggcgacatcaagaacgcctcagagcatcaccacaaaggattccccgacccggtcttgaagcgcctcggatggcaacccggaaagtcatcccgaggtgggtcttaagacgcctcgggagcgcatcatttgactaacaaggtccgagccgctcaaccacaacctgagggtcaactcaacccggctcggaggaacatcaggtcgggacagaaccttcaagaaatgacttaaccaatatgagatcgaacataccatttccgaaaaacccggaagagatattagagaatctccgacgatatcaccaaatataggagtttccagaatcttcggaagataaagacaaatctccttcgctagctctaagataaggagaaatcttccgagaatatcgcgagaagcgatctgataaagccctatataaagaacttctgaggacaaagaaaaagacacgcacaaaaacgctcttaatttcaggatatcaaaaacgctctgattttgaaggcaaaacacttattttcatatttctaaacacttgtacgatcgaatcctcattatttcaataatataaccaagaacaccgtccgcggtaatcaacaattctgttgttctttgagaaactcaaaaagatccgttctttgaagaaacccttaatacaatttctcttgtgcgagtttcgactctcacaatgcgtagagcaaggtcaaacgttttcttgtatgaagagtcatgattgtcatgtattcatgcaacgattattgccatttgtgttaatagagttgctacctgcaaatattcatgaagcaattgcaggtaataaatatatatatagattctatttctattctttaactcagttattaatagacgactattaacttacattaattcgatatatgataggcatcagatcatttttcagggacctatgtacaagaacattgacaactgatgtcatagaacaattagacaagaatatcccagtgttactctgtaacttggagaaattattccctcctgccttttttgacgtgatagaacatttgccgattcatcttctacatgaaactgctcttggtgggccaatgcaattccgatggatgtatccttttgaaagattcatgaaatctcttaaagaaaaggcaaaaaatcttgcgagagttgaggggtcgatagtcgcaggaagtttaaccgaggaaacgtctcacttcacatcgtattactttagtccaaacgttagaaccaaaaagactcatcctcgacgatatgacgatggaggtgttgcacctacatataacgttcctgatgttccagatagctttgcccaaataggtagacttgcagagaagtcgaaagaagtttggtgggatgaccatgcgatttctagagcagctcacaattacatactccgaaatgttgattacattaaaaaatttgagaggtacaaagccagacaaattttattcataattttttatatttaataattagtgtgatactaattaaggactaattaaagaagctaagcatctacattttaatttgtaggttgtttgattcacaaatccgtgaagcatatcctggattagaagataaagaatatgaaatttacaaagatcatgattttgccagatggttaaaattctatgtaagtaatatttcgaaaatttgatatcttaattacttatgttgaaatgataaacttacataatatttactttatgtaggttactaacggatgtggaagtgaagctttaccactttggttgcatgagatcgttcaaaaaccaagatctaagatcacaaccacaccgatgtacttcactcgcggctatacctttcatacatatccaaatgaaagtcgaagggcaactgcagattatggaatccatgtcgaaggtgaaacagagtttaatgagattctgcaacaaattcttgaagtcgaatatccgagacttttgaattagaaatgcgtccttttcaagtgtgattggtttgatcttgttatcggacgaggggtacgggtaaataacttaggtgtggtcgaggggtacgggtaaataacttaggcgtggtcgatgtcaatgcaaacaagacttattcaaagtttgaaccatatatcctaacatcacaagcagggcaagtaagatttctatcttatccgcgtgtgaggcctaaacgtgaagtgtcgttatcggttattaaagttaatcccagaggccgtatagtcggtctagttgatgatgttgtgatgcaacaagaaagtgttagagaagttttcatacgagacataaccacagaagatgttatccacattgacctacaaaacagagaattataagacatcatcactgacggttccgaagaagaagaacaatcagacgaatttggcgattcagatgaagacgttgagtcagaaaatgattgtaatgattcagatgttatctattgtaacgttccagatgttttaattaacaagtatataataaataaattcagaaaatgattttaataattttaaagttataattatctaattttaaagtttatataattataattttgcattttgttgttctttttatcattatttttataaactttttttatttttaaattcatccctcgcaaaaccctagcaatttgcgaaagatttactacattgccttgcaactccctcgaagagtaaactgaaaaccctaatcgagtcaccgtgtaaccctaaaattttgcgagggatttgctacggatcccacgcaaaattggagcaatttgattggttggtttctcggttcttcgcgaagccctagcaaatttgcgagggatttatgaggcgttttatttttatatatacacagcgaactgagtttgagcgaatctcaaacccagccgcttcccaaacaaaccctaaattttttcttctctcttgaacctttcttcgtcttcggccccgttccacctcgcctctgtgtcaccgtgttctccggctagttcaggatcgtcgctcagacccagccgatttcttcttctccaacttgttcccgatctccgttgtgtcttcttccccgcctctactgtcccacgaacaaggtaatgtctccaatctctcagttcttcatttgattttcacttgttctaactagggtttcactcaaacgagtttctctgtctctaatctctcagttcttacatcgattttcacttgatctagttaggttttcaatcaaacgagttactatgtctctaatctaattagggtttcaatcaaacatgcaaatctgtcacgagttctttagatctatttagggtttcttaattttctaggtttttcttgtagatctaattagggtttcgtgttttcgatggatttcggtttagatctaattagggtttgattattttttgactactaatgatttctttttcattgtaaacgattattcaaggttccggtctcaacagcgtccaagcacgcctctcagtgaagggaactcttctgcgattcagggtaatggccaaaccggcggacctcagccgcttatcaatgtcaacccccaagcaggcggtgcgtctcctcaacaggcaaattagtcccccaacggttctgtcaatcatggtactcctttagcttctcggcctatcgacatgactctggatgagttacttgaaagtcctggtcgtgcaagtttaccgagattggaccctaactgtaacacccccgaaccattctaggactaaaaacgaatccggaagcgttacttttgatgcccgtagacgatccgaccgagttcctagaacacatccggcaccaaggtcaggccatcctcgaacatcgttcctcacgaacacggcctaaggcttttcaacccgtaccatgtttgtaagttatgttagtccggacaagactaatatcagaagtacacaacgattttaagaaaaaccttctttattcaataaaacattaaaatacttacaatgtattgcgatcccgagcctaatgctcaaatcgagtcaatttacaaatctaattttacaaagacaacaaactctacaccggttccccaacgtccgtgctccctttaggtctccccaactaaggttacctgtaagacaaaagcagaatcttgagtaatctaagattacacagtgagtccgggtttctaacaattaacaaaaatcccaatcccaatccccaatcaaacaatcagtacgagtatactcaattgagtatactcgacaagaaatcacacaacacaaacaaacaagcaatgaatactctttacagagtatatgcagcggaaactactaaagctaaaactagcacgctaacgactcttcatcctacgggccctatactatacgatgctgatttcccacaaggcaatgtctccgaccgctagacacaaagtctaaaacgatcgcatcccttccccaattcaaaccgtgtacaagggaccaactcccttacggtaaaacttttactaccccgtcgggtagtcccaagtggtagcgaaccattccgagatattgggacaatcacgacatcgtcacaccttagtcataaaaatgactaaccacattacttactacgagcctaatgtaacctaatactactcgtaataaaacctaatagcaagcaactaacacacaaagattaatcaagccgaaacaagattaaccaacaacaatcaatcaatcaacaatcaaacaacctaacatgcttgctaacaatttaattcgtaataaaaattacgaacaaacaaacaaacaaacaacaattaccgcaaataaatacgatagtaaatcctaccacaatcaaacataatggctaaactaatgtctagcctaagcacaccaaatacttcatcccaaaataaatgaagcatgaatgcaagatctaatcaaacaaccaatccgatcatacgtaaaaacgtagatccgactatcaacaataaatgcatgaattatactaagtataaaaattcaacctcatgcctaacaatcataacccaaattaaaacctagtcatgtgctactacacacgctacggtactcaccttagccttaatgtcgagagagtagaattctacccttgaccgcctaataattttgatccgaccgagctatctccaacgcgtactaacgatggatctaagcgtcggaccaaaaacaaaattaagaaaaatattctaaaaagaataaaagactgaggacggaactacttaccttaatacccgactacgactcccgactcgaccaacttctacccgactcggactcgacggactaactagctatctaacggtttaagctaaaggttttggtgtggatggtaatgaactacaagtgaaatctcgtgggtatttataggtgtgggaaacttggagaccaagtcacgttccttggagtgcaagcaaagtaatggatagggcttatccataaccttatccattctcatgcttatccttatcaaaaaccatgtttatccttatccaaactaatacttatcctcatcaaaacgcccatccttatccttacacaagtagctgcacaagcagcttacgacatggcccctccacgagcactcgttccgcttactcacggtatacgcccgtaccgagaactctccgaccatcgtacgcggacaatgatcattatatattcttctaaaaaatgactaagtcacttaaatactccactaaaccttgttgtgtccgcatccaatcccattcgatcaccgcttgcttgtctcggcctaaaattactatttctcgataaaactagatttctccgataaaaactagtcttccgcacttcctttattttcctcggcaaattgatctttccatcaaccaaattgcccaaaaaggtctattgacaagaatcttgatagtcctaataacttctgtgatagccttaactgcctttgccgataatagtcgatcctaatcttcttgatatgtagcattagccgataaaatctctactctcttctaaactgatcttgagttccttatgtaacctttctttgatcaatgatcattcgggtaatgtttgatttatccacaactccgtctaaattttcttatcaaaaatttttctaagttacgatcgcaattctacgttcgcgaccgtccgacggattcctagtcatagtcagaggtattacactaaccgtcctccgcaactctctggtaagccaattttgtctgtcaccttaagaatatttaggactagtctcagttcacttttgtctggctgatggagccttgtgtttgtaggtttgacgatgaccatgcagttgcatccattgtctggagcatctttgaaagagatttcaaggaacctcatgctaattggacacagacacccttaccagtgattgatcgctggtatgaaacctttgctgtaagtgcaactaaattgtcatgttttgttgtgtaaagctttttagttgctgtaagtccaactaattttttatgtgtcttttctctgttctgtagcaagtgtataactgggaccgtgcaataaacaagagagttaggattgagtttgaagctaagttgaaggataggatgtctgatcaagtttctcggtggaagggaaagtggagagaaaagggagatgcggcgatccctcgttggtttgatccattagtgtgggttgttcttgttagtttttggcgagatcctaagtcagaactgaagagtatcgatagtaggaatgcaagatatcatgatcctgatggcctcgggattcataaacaccggtctggcgagacatcttacaaagcccgtgccaaaaaacgtgtaagttattttacacccttacttagtcaacttttttacacaaacaactaacctgatttgttctgttttagtgtgagatgaccggtgaaactactcaagattttcttttgctcttagatgagacacatagaaaatttgatggtagtttcaatgataaaaaaatccgaggagatctacaatgaagtgtcatctaggattcaagaggaggagtttcagctgtgttccgacaacacgacggagagcgcagcttcagggggtttatctgttcaggccaagaacaagatttatgctgctgtaaattctctctctctctctctcttctatatagtttctgaattgcgacttgggattgtgttaagtgttttgtcttgatttttttttgtgtgttgcggttccattaagtaatagtgacttggtattgtggcattgtgacttggctttttgttgttagtttttgtctgactttgtttttgtgtgttgccaatgcattaagtaatagtgacttggcattgtggcattgtgacttggctttgtgttgttagattttgtctgactttgtatttgtgtgttgtcaacgcatttactaatagtgacttcgcattgtggcattgtaacgtggcattgtaacttggcattgtggcattgtaacgtggcattgtgttcagtgttttgtcatgacttggttcttgtgtgttttggttgcaattgtcttagcattgtagcattgtgacttagcttatcatggttgcattatgtaatagtttctcggcattgtcttgatttgtttttgtgtgttttggttgcattatgttatagtgacttggcatttgtttttggttttgagtttctcttaggtggctccaaagaagaaagggaggatatatggggctggttcattgcagctagaagcctcatcagctcacattggttcttctgttcctcgagaagattcgattgaactctctcaaaagctggctgccgcagaagctctaattgcaaaccaagcggagaagatcactagctttgatgtgtacttcgactaccttgcctagaaagatccagacttcaattcactgccctctttcgagccagatcctctaggactgaacctgtcagatccaacctgagacctgaggtgccaaatgccacaactgctacatctgctgggatcgcacatgtgactgtcgaagctgaaacagttggagctgaggcaaacactggatcctctccatctcacactttctaaggcacttgctacactctgttttaatttcactcatcacaaaccctagacaatttaaaaattgtataattattttgttagattcaaaattgtatttgaatgtcaaactactttcagtctttaaattatgagtttaagctttcaaataagtttccaaattagtttcttaccttaaataaaaagttaagattagattaaattaagaaaccaattaagaagatcattaattaagctaaacacaacagtaattacgtttacaaaataattaagagcgtcgcataaacctagcaaatccatcaaaaaatttgctagggatttgctactacgaatacatgaactcacaactctatcgcaggtttgctacagataaatgaatcgcaactccctcacaaagtttgcaatgaatttgctacatttattattactcgcaaattgcgagtgaatagcgagacatttattcctttgcaaaatttgcgagggaattactaccgattctcatttgcaacaagcgttttgcgagaaattgacattcgtcgcaattccctcggtaatagcgatttgcgagggattagatatgggatcttccctcgcaaaagacttgttttcttgtatcacacaagaaatggattatatactgtgaaatctggttatgatttgtgtagcaggaaaacgcataaacaactcttcacggaagctgaatcaagaccatctctaagtcctttatttgaaaaagtatggaatattaaaacggggccaaaaatcaagatgtttatttggaaagctttgaaaggagctcttgatgtagaagacatgctaaaaaattgaggtgtgaatccaaaagatggttgcttgttctgtgaagaggacactggaacaattagtcatatactatttcagtgtccattagcaagacaagtatgggcattattgaatgtaccatatctagtgcatggttttagagattcaatttattccaatatgaatcacttggtgcagatttcacaggcctagacagttcctcaagacatcggatatgttaattcttggattttatggatattatggaaaaacaggaacaaaagcttttgaagaaggacatcaatggtggatggctcagagaaatggatttcctttgactggagctcaagattctctggaacaaagatgtattgcacctcaatttggagagctaaaatgtaacataggttttgcatggtttcggaaaaaacctctatctggagctgcctgggtggttagggattcatacggttcagtttactccatagttgaaaagcctatactctaggtacactttttgtttgaaagcaaaacttaaaagttgggaatggactcagatggtatgaattggcacaacttggagagggcttcttgttttgaagtcattcaagctctaaacaaaccaatagaatggctagctattatcaatcacatagctgaattgttgagttttacaaagaacaagccaaattggtttgttatcatggaacaaccaagtgctaataaaggtgcttttgagatagcaaacagtgtcttaacagggtttcgcctgcaatcatatgttgcaagaggacatcctcaatggcttgctcaactttttgcgaatgagagtgttaagattcatgaacacatttcctaaagaagtttgaaatcggagaatgttctaaacgagaacaagctacaaaggagaaagaggtaggttttcagttgccttcaaagaagcgataactcactctacatagtctgtcaagatgtttttggtatgtttaacaggaacaaaggaaggaattttttggctcatgcattgtcatcttgcaggattaagaatgttgacaaagacagagtttagtcctttcaatcgggtttaagtctaaattttagtctaatatgttgaagtttaacagggattatcaattttcatgtgatggatgtcaccactgtattaatacgactagagaaaaaaaaaaaaaaaaacgtaatcagattaggcccacttaagccggttctccttgacagaaccggttggttttttctgtgaattactaaccagttttatactgtcggatccttaaaaaacctcataaacccttgaagctcgaggaattgtgtaaaaccactccaatggcgattctggacaaattgtttcgagcatctcgagcatggcgcggatcactctctcattctaaatccatggttccttcgcaatcaccacgggcacgagagcttcgtcgctgtttccaccacggtactctagcgaattcaatttgtagataatttttggtgatcccttgatttcgagtgaatccatttgattgtaagaattgctaattagtttaaaaattggaactttcggggaattgagaacacaagaagctgttttgtcttatgatcccttaattttgatttttggtcatgtacttatgatgaagaaatgatactacttctctgtccaagtagaatctttgtctcttagttaaaagtttgggtctttgatattgcaggaaactttgagcagagtaattcaaaagtaaatcaagtcttgagatcttgcagcaccctaaacgattctccatacttttccatggcacctgcagttttgggtgctctctttagcgttggagtaattggagtagcttatgctgaatctgatgaggttttgtaacacaacacaaaaacaacaaaattgaatcattggtgttgaactgttgatagatgtccttttatgtaacacagttagttttactgactcttgcaggctaataatgacaagtcttctgccccaatagatcctaatgacgaaacgtcatctgccccaatagatcctccaccaaactatgtagacattgccaagaaagaacgagctcgagttgaagaacttatacaaagtaaaggaactcaatatggttcttacccacggttcaatgttgctgtaagaggtcaaaaggtttccgcaatgatccctctttttttgtttctctagtttcaagaatttgggtatatgactaacttctgagtgttccttgatgcatatttgtgatgagacaaatgtttgttctatgttttagattacgttgaagttccaagttccttctacttgtgaagtcgcacaattaatatcaaacattggatcccaactaggtgtgaaagtctcagatcgtactggtggttcagatatgctattgcgtgcttgggacaagtaattttctttctctactcaattttctccaagatccaatatttgaagactgatctatagttaaaattaatctctactccattcttgttacctcagtccagtcgcttggcaaataacacttcgcagtgtggaaaacaagaagaaacttggagagagtgaagatgattcagatgatgacttgtgcattcttatctttggttccttacttacctcggataaagtggtaagttttagttctctttcgaatattcactcaacctttaaatggtcttttgtttgataacatcttaacgatgcttcaaaatgtgttaggaagttgagtttataaagaagggaagtttgactactgaagaacttgaggcttttgtttcagctttgggagtagctggaacaaaagctggacaaaataagggaagcggcagtagaggaagcactcgtgattcgtctacagacaaatctatctcccagttggagtctatgggagtcagaatctatggagttaataaacctcttggggatgattctatggatgagatatcatgggacaatattgctggatatgatcagcaaaagcggtaagcttttgttacatctttgccttgtattccattaatatggcatataatatattagtttctatcatgatgcagagagatagaagatacaatattgatggctcttcatagtcctgaagtgtatgatgatattgtacgtggtacacggtccaaatttgaatccaacagacctcgggctgttctatttgagggtccaccaggttagcacaagaagagtgcatttacaatttcgtcgttctctgtagaaacaaatttgaatctgatgtccataaactctaaccataggaactgggaagacatcttgtgcgcgtgttattgctaatcaggcggtgagtagtcgataacttgcaaaccctttttgacctttcaatttttttggaatctggagctctaacgttttgcgatatttgtcagggcataccattgttgtatgtgccgcttgaagctgtaatgtctaagtactatggtgaaagcgagcgtcttcttggggctgtgttttctcaagcaaatgagctccctgatggtgcgattatatttcttgatgaggtgaagaaaatattactccttttatattgttgtctgacttttcctttcaaaatttgactatgttcaaaatttctacttgtctaactcacaatccagattgatgcatttgctatctctcgtgatagtgagatgcatgaagcaacgcgtagagttttgtcggtactactaaggcaggtaacacattcaaaattgccaatatcacatatccacgagatgagagactagttattaccagtctgatgaatctgcttctatgtttttgcagattgatggatttgaacaagaaaaaaaagtggttgtgattgctgcaaccaatagaaaacaagatcttgatcccgctttgatcaggtaagcaattaaacatttcaaacccagttcaattcgtggctgcagtatcctgatcagtgtcctatgtttttcatctgtgtatctttagccggttcgattccatgatcatgtttgacttaccggatttacaaactcgtcaagaaatcatcgctcaatacgcaaaacaactctcaaagcctgaactagtccagcttgctcaagccacagaagcgtaaagtttccaactttcctttaccatatcaaactaaagttcgaaactttttatttgatcaacttcaaggccacccgatctttctattcctgattaatttgtgatgaatccatattgacttttgatggttacgcagaatgtcaggcagagatattcgagatgtatgtcaaggagcagaacgaacatgggcttcaaaggttaaaacggaatttcgtcttctacacatggctaaatgttacaccaactgcagatcattaacctttatattgttggacagttgattcgtcgagcaaaagccggtggagaagaacaaaagatcactcttcctccaatacaagagtacttggaaagcgctgaagctcggcgcaaatctcttcgtagtgtcacggagcagaaggaacagaaatttgctgctcgctccaagaaacctctgcttgattttgagtgacaatattcatctagcaaacaatacttacggaggattaacttacttacacagacagtaggaagtttcttctgttctgtgaatttgacttgtcaatatcaaagcctgaagatgttgtaaaaattacagttcataatatatgaaagtactaggcgtttgggtacccattcgggtttggatcgggtatttcggattttggggttttcggatttagaggtagaacccattcgggtaattcttgatttcgggttcagatcggattcggatcagatatttcgggttcggattcggattacttgaagttctcaaaaattaaatttttataaccaaatcgatccaaactacttgaaaataaacaaaatatctaaaaacgttgaacattttttacccaaatttacttaaaaagtatattaaaaacctaaaaatattttaaatattcaaaaattcacatattttgacacttagattattacaaatataaatatttatagatattattactatgcatttaaactatagatatgtttggatacccgttcggatatcggtttggatctgattcggtttcagattttagggttttgaagtataaacctgttcggatattttaaaatttcagattcaaattccgatcgggagctcggattcgaatattatggccagccctaaacgacgtcgtgtttgaagatttagacttgaaagcgaagaaacaaaatatacctcttttaaacaacactatatgtaagaaacccaactggaacatggtgggacctactagagacaatactcgtgttactaccgtcagatgcttttagatattgtcgtctatcctgcggtcgagatttcgtgtaatttcaaagctaataccgtgatccatgatctagtagtaacactgagaagagggactgtgtttttaatcggctgcgtcggatcatttcctgttgttatcaaatttttctaatccgtattcgctagttgctttctgcttgttcacgcgttgaatctcctcgtactttgcggaattcagatttctcgaacgggtatgtacttgttatgcctagaaactgttcgatgaaatgcctaactgagaatgtttttacaatttctctctgtttgatgtatctttttttataaatgaatgttcagggtttacaagtttggtttgttcttcagttcttgaagtgatttgatacggagcagtcatggatggtgagtgaatgattcttgtgcaattgtgattttgtttttgcttcaaggaaggccctttcttcacttatctttgggaattggtgaattagatgtagaaacttaggaaaatgctataaagctttgttctttgctattgttttgtatgatgtaaaacttcttagtataacttgttaaaatcccaatctgcattaccatcaatgcgtagaaattgcttggaaaatttaaattgaggttgcatggtttttgaatcctaagaccattttttgagaactgtaacattggtgatttcaaaatattcagttgattcacaaccaatgatggaggagactatactggtcggtgatgacctaatgacgggtcctccatctcctgttatccctcctgaaattgcttcacatgtgcttgaaggtgttgatttgtgcgatgggattttgaggaatctattcctgtgtatgtctatgtatcctcggtttggtttataattctacccttacttctgtcagtgagtagaattgttttttttttttttcttgttttaggtttgcaaatcaatgatattgaaccattttgccaagatgagcttgcattgtatcgacaatgtgctgaaaagagggtaattgttgtttagccatcggctcggattatagttatataaagcttttcattctcatatcatatccacatccatttccttgacttttcttgttcttctatcctttttgtaggacaaaatattgagagttagacttcaagagagcgaacacaagttaggattgtctatgcccattgaactcgctaaggaaaggattacgcagcttgaagctgaagccacatcttttgagaggtactctttcttaacaatgcagttatattttgttttggattttctttacatgaagagtttgtgctaccatgtaatcatgtatatctacagatgttcacaaatcgaaactatgttcttaaatccaaatgttcactaaaacagttcatttgttttataatcaggcacttgattctagcaagtggagctgaaggaatagaaggatttcgccggagatggagtttacacggtcggatgacggataccaagtactgtaacaaaacctaaccttataaaacaaccaatgctcataatataatatcatggaattaatatgctgcatgatagtagatgaacccatcatagtccttcccaaatgctgcgtacataaatctgatttttagcattatcgaaagtgaagcctataaaccctttgtgctacagtctgtattactttggtttgtttcttagcttaaagctaattgtttttattgtgtgtggatgtcacagaaaaagactggagtcactgaagcagggaatggagaacaggaacaaggttgaacatgaacataaccaacaccatgatcagtccccaaaaccttctgctccaaaaagatggttcttttggtgatttccatattgaatcatgttttggatcataaaaggttcataatcattacacttatggtgcagcaatgtaaccacttttagctattaaaagtaacattaaaaatctaaaaagttttatcttctccattaaattcgctcttagtctttacaaatgtcaaattgagtaatcaatttctttcggtaataatagggatgtgcattttaactaaaccaaaccgatccaaaccaaacccaagtttagattcaaaccattcggttatgtttcttctcaacccaaatggttcggttcggtttggtattaaacaaaccgaattgacaacccaatatatttatttaattaattaattaataatattgtatattactaaatatgaaatagtttgcacttttaatttcttttcatggtttttttgaattattaaaacttttgcttaagttaactattatcaaattcaaagttcaaacaataatgtacggttacaatgattagttttttaaaaccgaattaaaaccaaaccgaagaagccaaacggaaccaaacccgaacatagattgatccaaacccaaaccaaaccatactaacctcggttgagtttgattagaattttacaaaacccaaataaatcgaaccgaatcgaacacaaacgggaccagaaattaaacagaaatgccgaaccgaacttaataatttcttgttttttctgaagcccatttgaggcccaatatctccctctacgaaacgacatcgttcttaccgaaaacgtctgctatatctgacagtatctagcactctgcaagagaaacttcgaagattttgatattgtaacgatccgccatggaagagaagaagacagaatccgcgactaagaacgttaaaaaggttaacttgttagaccacatcgcaatcaaacacctccttgatgaatccgtctccgatgtaagtcataaacacatcaatcaatccccacaatttcgttctcgatatcaaagttttgtcctttatcgctgtgtagatcgttacgagcagagggtacaaggaggatgtgagattaagcaacgtcaaatttctgttaggagggattataatcgtggttgctcttgttgctcaattctacaacaagaagtttcctgagaacagagactttttgatctgctgcatcggattatatccttttgattcccatttgatttgctagggttaagatgaaattgaattgaatttgataattgtttccttgtgtatggcttgattggtttgtgttgtgtgcattagattttgagatactataatgtctattaggtatgaatgttatgtataatcagagaaatttctcaaagtctttatcttttggatataatttttgaataagatgtgggatttgtttgcttcttgactttggcaagtatgtggtgttgactgcggtaatgcagctgattctgtacattaaggagaagaacgctatcttgttcacctatcctcttgaggtttgttctcttgactgcttagaaaatgtggttaggttgtgtgcttttgggctacattcttgtttttgcttgtatcataaccagggactgttgtttctgtgattcggtgcatattttctcttcataactagaactatattttgatgtccttctgttttgtaaccacttagaattgttcttctgctagcttcacatgtgttgtagagttctcatatcttaggtgatcttggtgtttggcatttgagctatagcaggtgctacatctccctttcactccactcattctaaaccaactttttctcaatgtgttacttgattcgtcgatatcttgattattcggggtgtggaagttcgtgtaactcttggtatttgtgattctggcgatgtcttgttatatgagacacacttgttcaaaatgattctggaatttaatgttggtgtttgtggcttttgttatttgtctcatcagctggaaaaagtttcccatctcaattaatttgtatacgaaaaaatgcgatctttcaaaacatttgattagttctcattatggttaaggtcagaataggcaacaaagctagagaactccatttgttttgccatttcagtttctatgataatttggtttgcagattattcatatattttgctactgttaggacatgtatatttggttgttttgctgacttgaaattcggatggttaataatatgcagggatcattcaccagcactggtttggtggtatcttccaagttacctagattctctgatcagtacactctaaccatcgacagtgctgatccgcaatcaatctcagctgggaagtcggttcagttcaccaaaagtgtcactcaatggtctctttctttctgcatttttcatacacgtgctcacaccatatcctttgcattgcgtaagctgttgattttgtttttgtatgtgtattctaggctcacaaaagatggagttcttgtcgagggtttattctggaaagatgttgaagccctagtcaaagagtacacagaagcaggagaaccaaagaagaagagatgatcatctataatgggaaaagtatgttgctccttattagttctaaatgttacattttttttatgactaaaatcgatggtgacttggtttaaaagacgacagagtttttgcctcctaacagaagattcattcttataaattggaaccaaattttcaaatcattccgagatttttacaaccatcgatcttatcatgttctcttatttggaaatgttgccgtaagctagacttgttcggtcttgtctggcctaattcagttattttgttgttattgatcacttaagaaaatgttatgttgggctggtctggtccaacccaatcagtaataaacaacttaaaatattagttttcaaaaaatccgatctgaactgaatttgtgtctgtccgacattagcttttaaccagagtaacacttctactctaactaggtatgaccaaaatttaaccataaacatattttgaaccataattgtattgtttttaaactggaaccgaatcgtaacctgtcaattatgattaaaaccgaatcgtaacctgtcaatcgtaatcgtaaaatggttaaaaaccataatcgttaaccgtaaaaaatagaataattaccgttaaaatatatattaattgtaactgtcaattaaccataatcgtattaaaaccatagttaaccgtacggttaaccgcatagttaaaaccttaaaaatacaattttaactatttataatgcaaagataaatatcaaatgttcgaataaagattttcaaaaagtaactaaagttgcttataaaaaaatctacaacatacttttcattttcttaaaagcaattaaaaaaaagtcggatgatacgtaagattttgccttcagtattaaatgtatcgtaaccatcaaataaccataagcatatttaaccataattgtattcattcgtaattttatataatcgtaaccgttttaaccgtatatataataattaaagttatgtttacaaaaaatttgtaactataattattagttaataaatcgtaaccgtaataaccgtaaccttagtgatgcctaaattctctcattaaagcgtagataaaccggtgttaaaccatgaaaccatgagattttttccccctctcatttgtgaagttgattctaaaatttaatgaaaaaataatactacagtaaggtattaatgggggtggaatatgaagatattataagcttaggaatattaaaatagaacaagaacaaaacgtcactccacaaggaaagttactaaaattgacaaaaccacaagtaccaacaaatctaagttttgtattcctcctttttaagttacataattccccaattcctccaccatatcacgcgcccacgtgaattaaccagacaccacaaaccacacacattagttataacctccacgcgcttaatcagcgcgtataacaaatgaacgtctctctagcgttgttcgttttgatatcttctcgacttctccacttctttagatttgattcttcttctctgatctctgaaaaaacacaatgtcttcgaaagacaagaaaccgtcgaagccatcgagtagtcgtggtggaatccgaactctttccgatcttaaccgtaggtctggtcctgactccgacagtgattccgatggtccacaagaatactacacaggtggtgagaaaaggtcagtcttgtttctatttcgcaagtgatactaatggtgatgtggatcgtcttttgctatgattggatctagatattaattgtgaggtttagggtttcatgtctaaataatgtttttattggtcttgtgttgcagtggtatgttagttcaagatccatcgaaaaaagatgatgttgatgagatatttaatcaagctagacaactaggagctgtagaaggacctcttgagccacctccgagttccaggagtttcactggaactggtagattgctttctggtgaaaatgtgcctactggtaatcaacagcctgagcctgttgttcacaacattgttttctggtctaatggtttcactattgatgatggtcctttgaggaaattggatgatcctgagaatgcatcgtttctcgaggtgaatgactttcatgtgaaactgttttgatcttttgtttttggttattgatttagttattgtgttcttatagagcattcgaaagtctgagtgcccgaaagagcttgagcctgccgatagaagagctccggttcatgtcaacttgatgcgaaaggaagagaaatgccctgtgagtcccctctctgctttatccatattgggttactagtctctcaaagttgtgttagcaaaactagcattttggtcatacattacaaaaatcttggtagattttatatgcgataaccggtcttatttaatcgacttaccggtcttgtttgttattgtaggaaagacagaaacgtagggtttcatttcagggtgttggaagaactctaggtggtagcaatgaaggtagcggaagtagctcacctgtggctccagactccgctcccattcccatccaaaccgaaccagcaccatctcaaagtcttgtaatagatgaaaccgttccaaccacatcgatacagcttagactagcggatgggacacgtctggtggctaagttcaatcaccatcacacggtcaacgacattcgcggtttcattgactcatctcgacctggagcctcgttgaactaccagcttcagacaatggggttcccacctaagcctttgactgatctcactcagaccattgaagaagctggtctcgccaactctgttgttcttcagaaattctagaaaattctacaaggtgtggttctttttgtctatctatatgcattataatgagattttcataactgttgtagtaaccaggtctttaaaatgtaagttacttcttcactctgtatactcagcataagccggcggggacttgtggtatagtttttcttaatttattgaaattttatagtttcattatgcgtttatgggttaaatacagtgtttcaagaacaactatatatagttatatattattagtttggtaagagtataatcaagtgtcatatatgcatgtatatcattgttgtgttattcatcaaccaatagttactgggaagagtattaataagcttattgagaatttgaaatgtatatgactagttttcatgaaattacaacattttgaaactaatgtttgtgaaaggaagaactagaatcttttcatattattttcagtagggaaaatgtcataaaagtcatcagttaaacaaagcaccaactttgcttatggtgaacgggtcaagacccatttttatcttttatttgtgatttttttaaaaacataaaacgacgtcgttttgcagtttaacgaaagatgggaatgttgacttaacaccgttaattttttcaattagttgacatcacgatatgctttttttggcaaagttaatacaagttaatgatttaattgaaaaatcaattgaaattagtgatttaattcactagaagcaaagtttgtgctttgtttcaccatttttcgtaaagtgatcatttttatgacatttttcctatttttaataactttacttcttcctttttttttggtagggtctataactttacttcttacaatgatgttatgttcaaaataaaaaggttcaaacttcttatgtatattttcaattaagaaaaaaaaaacactttcaaatttattaaaatctaaaagaaagattaattcttcgttaaaatatttttataagaaaattacaaagtaattaagatacataacacaaatgtgtaatcaatgctttcaattttcaagtcaacatgatgaaatttcaacaatttattcgagaatggagacatgtagacatgtgttgtttcaacaattcaatatgactaactttgttaaaggacaacatttaagtttgttgaaatgaagaatgagcattcttgcaactatttacaacaagtttattttttacaataaggctaggttcaaaataacaaggtttctaaatcattgcacttaaagcatgtacaatggttgggactgtcaaagtccctaaaaaagtaaaaagtaataatattttattattttaattatattttagttttttaatataaattggacattgataagattacacttgcaaatatgtttgtgggaacgtcctttaaatgaggactttcagagactctctttcatccctcttttactttttaaatatttttgttatttttaagtggatgagcctgtataaagagacccacgttggacgtgctcttagagttcgaacactttcaaatttacgaaaatctaatacaaaattaatactccgatttttttagctagtattaaatacttccggacttgtaaagtagttggagtcaatggtttcaagtcaacaatgatgaaatttcaacaatttacttaaacgctacgagagtgagagaccctaccagagtcaactttgttgatttgttcggatttggtttttaaccaaaaacttggatgacaaaagaagaacagtaaggggcaaaaagcaaaatgtcgaagcaatgtcttctctcctgcttcctcttcttctgcttcttcataccacaactatctttctcttgtccacaagatcaaagacaatcccttctcgagttcaagaacttgctgattcacaacatcaaggacaactacacagcctttgaagaattagggacatggaggccaaactcagattgctgcaaatggctacgcgtgacatgtaacgctagttcgccttccaaagaagtgatagacctgaatctattcttgctcatcccccctggcttagttagttcaagcattttgagaccgattctgcgtataaactctcttgttgggcttgatgtctcatttaacaacatacaaggagagattcctggatatgcgtttgtgaacttgaccagcttgatttctcttgacatgtgttgtaatagatttaacggctcaattcctcatgaattgttctccttgacaaatcttcagcgtcttgatttaagcaggaatgttattggcggtacgttgagtggtgacatcaaagagctcaagaatctgcaggaactgatcttagatgagaatctcattggaggagcgattccttcagaaataggtaaactagaaaataaattctcaaatatttaaattttatattcatgtgggtgttaaaatgtcctaccttttaaaatgttgcaaggtagtcttgtcgaactactgacgctgaccttgaggcagaacatgttcaatagttccataccgtcgtctgtatcacggttaacgaagctcaaaacgatagatcttcagaacaatttcttgtcttctaagattccagatgatattggaaacttggtcaatctatcaactctgtccttgagcatgaacaagttgtcgggtggaattccatcgtcgattcataatctgaaaaatcttgaaacccttcagcttgagaataacaatggcttgtcaggtgagattcccgcagcttggttgtttggtcttcagaagctgaaggtactacggcttgaaggaaacaacaaactccaatggaacaataatggttatgtctttccacagtttaagttaacacatctgtcacttagatcttgtggcttagaagggaatattccggattggctcaagaatcaaacagctcttgtttacttggatttgagcattaacagactcgaaggaagattcccaaaatggctagctgatctgaaaatcagaaacataactttgtcagacaacagactcacaggctcactgcctccaaatttgtttcagcgtccgagcttatactatcttgtactatcaaggaacaacttttctggtcagatccctgatacgattggcgaatcacaggtcatggtactcatgttgtctgaaaacaacttctcaggatcagtaccaaagtctattacaaagatcccctttctcaagttgttggacttgtcaaagaatcgattatcaggtgaattcccgaggttccgccccgagtcataccttgagtggctcgatatatcttcgaacgagttctctggggatgttccagcttactttggaggatccaccagtatgctcttaatgagtcagaacaatttcagcggcgaatttcctcagaacttcagaaatctttcatatctgatccgtcttgatctccatgacaacaaaatctctggaacagtcgcgagtttaatctcccagttatcttcttctgtagaggttcttagcctgagaaacaattccctcaaaggttcaatcccagaaggcatatcaaatctcacaagccttaaggtcttggatctctctgagaacaatcttgatggatatctcccttcatctcttgggaatcttacatgcatgataaaatctcctgagccctcagctatgactatccgtccctatttcagctcctataccgacatacccaacatagaaagattaatcgagatcgaatcagaagatatatttagtcttgtagtgaactggaagaattcaaaacaagttcttttcgacagaaacttctacctctacactctcttagatctctccaagaacaagctacacggagaaatcccaacttctttaggcaatctcaaaagcctaaaggttttaaatctttccaacaacgagttctctggattgatcccacaaagttttggagatcttgagaaggtagagagcttagacctttcacacaacaacctcactggcgaaatcccgaaaacgttatccaagctaagcgagctgaatacattggatttgcgtaacaacaagcttaaaggtagaatccctgaaagtcctcagctagacagattgaacaatccaaacatttacgcgaacaacagcggaatctgtggaatgcaaatccaagtaccatgctttcctacacagaccaagcagccagctgaggaaaaagaagaagaagacaaagaagaagaagaaacaattttttcatggaatgcagcagccataggttgctcttgtggattccttatagcagttgtgttcatgtcttacaatgagttatggaagtaacaacccaaaaatgtactcataaaacaattcaaaataaaattttcctctaagttcatcatttcattaccaattgaaaactaaacagatcatcactctctaatggaaccacccgcaatcgaaacgaagcgcacacaaggcacaatctacaatgaaactagtaatattccgtcttaactaagatgaagactaaagaaagccagtaacaagggagacgagagccattgcgaaggacatgaatctgctacaacaccaccgtgaaatccacactaaattaaatcaccgtcctctagtgagaaaaacaaggataagccacaggaggagaaatctcataccttgatccgggaaaaaccgtcgatttgaagcaccaccgaccttgtctctcgacacgacaagtagatggcgagctctaagagcatgtccattgagggaccttacaagttttttaagaaaatccttatgaataatagcaaaaaattaaatcagaatggtgtaataaaccaaggtgcgaaccttgtttaaggtatttttggatgtattaggtgcgctgacgtgactgtatattattggatgacaacttttcccgtgttttttttctttcccattcccaaactatttttttctttctctcctctctcctctcctgttttctccgaatttcgacttcgacggatcaaattcttcatcgtctcttttcttatcatgtctctcttctcatacgatccacaagattcgtgatcgaagaggtgtcagaaaatccaccggaagagctactcttaccggctttgctgaggtcaacgatgtggcgctgtttttcggtggattggttagaatgttgatgctcataggatcctgcttgtgggttcgtctgctggtaaggttcttatatgtgattgaagttttgatttttttgctctttttgatgcttaattgtttatctgggtttaggttgaatttgatggcaagttaaagtctggtgcttttgatctggtaattgcttcttacaagttgatctgtaacaattgatttcgaattcagtatatggattcgtatacagattctgggctttgctttatgttcaaatttgtgtttgatcttttggtttttaagataaaaatgtgactcttttgctgcttattcacttgtatgtcatgttatggtccatgttctctaagtggttttagcttagataacttgtatgtctgttttctttactttaagttcaatatgacttgtatcacttcggctttaatgatattgttgcttattcttgtgttaacggactaaatgagtgttcagcttaatgtgttcagttttaataaaacttgtcttaatgtgatatgttgtcttaatctttagtttaagtattctatgttttcttatttgtgaatgtttagtcttcagtgttagtgtgttgtgtttcaatatgacttgtgttcgtaagaagttccatatgacttgtcttcagttttagttccaatgtgacttgtgttcagtttaagttccatatgacttgtcttcagttttagttcgaataaagcttgtgtttagtttaagtagcaaacaagcttgtgttcagtttaagttccatatggttgtcttaatgttaatgttcttgtatgtctcttcttaatgttggtttcttgttttgttacagacttaaataatgcttccaccttctctaaatcactccagtgccgacattacttgtataaaagagaccacatgttttaagtcaccacaagtttgtactttggtttgaatgcttgtacaccacaaaataatattccgaaaacactagttcttattgtgtattctatgacatcacttgtatgctaaacaataattttgttttcattgttctaaattttgaagtctctgtatatgcataccaaaacactcttcttttatccactgttattgttttaagtatccactcttcttgttctctacaacaaacccaataaacattcttctttcaccaaataaacactcttctttaacttaatacacactcttccttttacccaattaacactctttttcacaaactaataaaaatttctcacttaaggattccacttaaggattccaccattggacactaaaaattataaagattcaaccaaaaactttaaactctcatttacttaaaatttactattaaaacattgtaaggagttcttaattaggactccccaatggggatgctctaagccgctaacaaaagaagagacaccatgggccttcccacaaaatattaagagtaatattagtggataaccaaatttgacatcataattaaaaaactaaccatatgtcagaaatattgggtaaataattctttttgtggtacggtatggattaagaaaaaactaattaaccttgtaaacttatagtttttacaatgatatttttattaatggtgatggagactttataaggttctgtgaaaaaagaaaagagactctgaagcttcagtaagaaaaagaaaagagactcataggtagaagtcataatcatcgtgatattattacagagtagaaagagagtcatctgatagcaaaaaaattaaagaaaaaaagaaagaaatcatgtgttttttaaaaataacatgaatcaaataaaattagcgaaattataatcatcgtgatattattaaagagtaagtagtccagaaaaggagtcatctaatggcaaaaaattaaagaagaaaataaagaaatcatgtacttattaaaaataacaggaatcaaataaaaataacgaaagaaataacttggtatttgatactactaacgtggatctatactccaaggactcactttgttggttttgaattggaaatgatttagttgatggtgaataatggattgatcttaatcaaagcggcggaaagacgatgaatggggatgacgacgagatcgagtggatgcagcgaaatgaaaggggaacaaattgtacttccaagagtgatgaaagactcttagactacgagcttggatccaacttagatattacacactaagaagaaaacaagttgaaaagatattacacacttttcggatcaaacaagggaaagagaaattttttgattaaaatgtttgatgattgcaaatgaaaactacaatgagtttatattggagaggaggaagaaagggaagaggtgagagaagaaagacatgcaagagcatgcacaagtccacactcatgcaagctcatgcaaagagttttggaaataacaaaagcaatgaatgcaaagtttgaatagaaaagagaaaatgggccaaggcattgtgagtgggccttggaccatgaattgggctgataaagggaggtttgaaagtgttacttaggcctcattaaaaaccttgtcaagaaaacccattgggacaaaacttaacaagagaaaaagagtgcataagcaacacttaaccctttaccgagtctctcgagccgtgatcattatgaaggaggattgagccacgtcttcttgattcttctttagctccttgagtagtccattgatggcttggttgaacttcttggattttgatcttgttagagaacccgtcggaacgattaatgcttcttccggtacaagctgctcctcggcttcaaactgctcctcatcttcttgtggttcaagttgtttggttgcattggtcatgttctcatcagtatttgtacaaaatcttatgtatttttgaacaatagcatgtcaaaataaacaacagtatgacatattaaaagatcatatgtaaaacagaaatatagtatgttaaacggaaagataccagtacatcataaaatattacataaaattcaggaaaaccatgaaattttaagaagtgacatgaatcaaataaaaaataatgaaaaacaatttagcatttggtcatggtcaccgtgatattattacggagtaagtggtggtagagaatatccataaagggaagagaagttgatgacataaatccggcgatggaaataatccagtaaaagagagtgagagaaagagaaaaaaagtgagagaagatgagaaaatgatatgttagtaattttatttgcctctccgataaagtactgttgcccatggtcatttactctattctttttggtttcatggctattttgtacatatactcaaatattaaaacgtaatctatatatacatttttgcagccattttgtgaaataaatcctggagatgggacttatttacaatggctgctactggcatttattatttagttttaaaaaattttaaaaagatattaaccaaacgatatctggcctaatttgtttctaaaaatctgtacacaatctttccatatatcttttaaaaaaaaaatcgtgaattttactccacaaaatatgcataaatccgatttataacaaatatttatatcaacattttgcatagcaataaaaatactaatttataataagtaaaatattcacataaaaatcatatacacatataggaaaaaaaaacttgtcagaacaaaatgtgcacttcttcaggttagcataaagaccttccttccgaagcgttttgagaattaactctaagggttgaatgtgatcagaataactcttattgtaaataagtatgtcgtcaaagtaaacaacaacaaatttaccaataaaagaccttagaacctggttcattaggcgcatgaaggtgcttggtgcgttggttagcccgaacggcattacaaggcactcgtagagaccttgcttggtcttgaaggctgtcttccactcgtctccttctctcattcggacctggtgatagccactcctcaagtcaactttggaaaatatgatggcaccactaagctcatccaacatgtcgtatagtctcggaattgggtgtcggtacttgatggtgatattgttgattgcacggcagtctagacacattctccacgtgccatccttctttgggaccaataggacaggtactgcacacgggctgagactctctctgatgtaccctttgtctataggtcactcacttgcttttcaagctccttagactcctccggattcatcctgtaggcgggcttgttaggtaaagcagagcctggtacaagatcaatctgctgttctatgccacgaataggtggtagtccgggtggaatctcctccgggaataagtctttgtaccaatgtagtacaacttgtacttcagcggatagctcaggatcacctatccctgtactaagacattctttgaaaaccattagtagcacggtgcccttggcactcatggttttacaaacatctttagagcttaaataaagactagaacttcttacctcgtgctccttgttcatgtgaatttgtaagtcatgaacttctaagggactaagaggggcaaggttgtacttacggtcattataggtgaaagagtaatggttggtgcgtctattgtgacatgtagctcgatcaaactgccatggtcgtccaaggagaagatgtccaactctcattggcactacgtcacaaacgacttgatcgtggtactttcccacgctgaatgatacggtcacttgttaagcgagtttcagttcagtatcgtcattgagccacctaagcttgtatggcctcgggtgctttgttttctgaagtcctaacctgtctaccatgtacttgctagcaacattagtacatgaacctccatcaataatcattcgaggttaacgaacacactcaatgtcctgcgaatcacaaggagttctcctacatcgggatactcaatgtcctcatgctcatcagaatcctcttgctcatcttgtgactcatagtcaccactaggagtgaggatcatcaccctttggttcagacattctctcgccatgtgtcctctaccttgacatttgaaacaagtaatgtaacgagaacgagattgattagtactagggaacttaccaagtttgggcctagaggttttaggtgcctcattagacttgttcttgaacctatgatcactctctacgaccttgcttttgtccatggctcggttgttgcttgcattccaaggcgtgttgtttctggatcggttgcttaaggatgccttacgcctgatttgctgttcgacttgtaccgctaggtgtagcaactcatggagtccattatattgggctctctccacctttcgctgaatcctctcttgtaatccatctatgaattgagccatgagagcttcgtcagattcctctaactccaaggcgttcatgagcttctcaaactcctcaaagtactcatcgacggtccttgttccttgagacaacattctaaaatatttttgtaagtctttatgataatggtcagggacatacctcaaccttaagaggtacttcatgtctccccaagtgtttatgggaccaaatctttttctcctcctatcagctactgtcctatcccacccagataaagcattttcggtgagctgagcggctgctaaggacaccttccgagattctccataccataacattcgaagatgtactccatccgtcgctcccaatccatgtacacctctggattagattttcctgcaaaagtaggagctgttagtttgatatcttggttctattcacgaggctctactcctcgtgcacggtttctcatcaatggatcttctctccgttggtgttggcgtctcaaagggtcgggaggtggatcatcttcatcatccaagtcaggaaactcctccgcctcctcgcgggcattcctacgagcctggtcttgccccaattcaaccctgggatagggctgttctaagcggcctagccgtttccttaatccccttaactcctccgtcaaagtagccatcatttgcattacggtgttttggggaatttctgctgcctctcccatagtattacctaaaactgacatgtgcttagacaaaaacaacaaagaaatcaacgtaccacaacaatagaaaagaaagatcaaaaccaagaaacctaaaacttgttgaatcactttctgacacacttgctgatgtagtacaaagttaacaatatatatatatatatttttttttgattaatattacgaaactcaaaaacaaatacttaacacgaaataaaatgaaactgaaatacttgttttttgtttttttaatttaaataaaacagaaactagactaatgtagaaactgattcagaaagtaagccaggctataagaaacgatgaaacctggcaaaggaagtgcaactgcgctctgataccaagatgatacaagactcggtggtgagcttgtatctgatagagatggtggcttcacaagctggcggtcgcttctctcttgtgaaggaaagatggtcgaagatggagatctaacatgatggcgatcggttctcttgtgtgggatctattagaggggaagtgctggcggattgaagtacaccacagagatgtgataagtctctgatacagtacacgaacttggccttggtgaattgcacacacaagacaaagaacaagcttattctcttaagaacatttaaagagaagaagtgagaaaatgcggttctttattgataatcaaaggtgaaaaatcgttcaactgttgcagggggactttataagagtctatcagctatccctaaggccaaaattaaatgtaaaaacgcaaaaggaaacaaatttaaatcaaaacacaaaaaccattgttttaagaaagaaataagctaaaataaggaaactaattaagttctcttgaggagcacgattgagaacgattctagccgttgtctgggctgtgtggacctgcaaagataatataaactgaataaaccttacctagatgcgttttaggcccatgtcgcctgagtcacttcctgtagtacttcttgaggtacttctggagtcaagtcttgtgctcgtttgttggttggttccttgaagtaggggtctttctggagttcctcttgagtagcttaatcaacgtcttcgagctcttccatgtcctttatgtcttgttcttgatcttgactctctcgatcacttgcagatgtgacacttgaatcgttcgtctcttgaagctccaaagtcttctcttggtttctagaggtccttgaacctgtcaaatgatatttcatacttgggggagtagttcgttcaagactcatttgggtgaatgcttcaacaagctcttgttcgcctattagatcatatccggtatggggtgctacgaaccagtttactcctagctctagggagctcaaaatatcttgcacaactaagttgaaccttttcttcaattgtttagcctttgaacgtgtcatgataccctccgggacttctggtacaggatgtagtataagatgtggtacaggatgtagttcaacggtttgtgaagtaaggttgatgtccgcatcaaccatgaaataatagaatggtccacatggtgggtgtataggtccacaaatgtcgtcttgggctcgttcaaggaattctggtaattgtttagtaattttacttggcgatagccttataatcaattttcctagagaacacacaacacatgttcttttattcccttgataaatctcttgggatttcattgaatgtccatatgagctctctataattgtttgcatcatcgtggtgcctgggtgaccaagctgatcgtgccacaatgtgaaatcgtcatgatctcttttgataacatgatgtgattctatgtatgatgcaatcctgatgggagtcttgttaatttctccaaaatgtgtttttttccccaaatttttcagaagtgatacacatgtacttcttccattctcagttgcagactgagtgtcatatccacgaaggatatccatgaaggtatatatttttgaaactcaacaaaagtttttttgaatttggagaaaataatgcattatttatcgagaactttgtcttaacaggtaatccaaaatttgctttactcgtcccttcaattaagtctgtgggacctgatatgttaactccaacttttgttgatttcaaatcagagaaatattttttatgttttagaatagtgtgcgttgttctactatctggtatgcaaatatctccaaggtttgccttggatattgttccatttgtaatgtgatccatttcctcaatatgttctgcgaggttcacttcctttccttttcccttggcggattctttgtatagagcacacagatgtgctggagttcggcatacctaagaccaatgttccttagtgttgtggatgtcggatctcgtcagtttgccccgacccaagatccatcatcatcaatcagtgggctcaaaacggtgggcctgaaaccacccgtgacgaagtgggcatcgagggcccatttgaggcccagtacgcgtaagagtatctgcgtgttacgtaacagaaaatcaccggactaaatgaggatgcgttaatatgggaagtggcagtttgaaacgtaaacattaatgaggcatgatttgtggcgtaattcaagcgttcagttacttcgtagatattcgatttgattgtataaatagaactcgatcatcatttataagggggacagaaaaaattactatacaatagaattccaattaactgaaatattgtccgatttaatcttagctcggctaacaaggttaaaggtcctcgtaacatccacaaattcctaattgcggattctgacatccacaatttagtgctaaaaggaggagagattaaatcttttacttcatagcttcggttaaatcaccatgagcaccagcgacaaccaaagttccggcgaccaagcctccacttagttattttccggctaacactaaaaccgagtctatctcgtaattcggaaaattaaaccaagtaaacataaaacggtctccacgatcttaaataagttaaaaaaaacaatagagttaaggcctctctggccaggttcaaaaaagaaaaataagttttgaaacaaaacggggggtcactgcggaccaacacaaccccgactcaaacataaacttttttactctgcagcttcggagttcttctcaacgtcaacagggaacatggcggcgattcctgcttcggcggctgtgtccttgttggttccatgcttgtctatgattaacacttcatctgaagcgttggaatctgcaatcacttcgggtggggtatctgccagaagcgaggtgggctcaacagggtttggacgtggggtctttggttcggcagccttttgtgcgaacttaatttcgtctgcacgaaccgattcaagttcttcagctatgctgggtatttcccccttctcgatctcttcgaggagctccctgttcaccttgacttctgcagctcgaatattagcagcctcaacttcatcagattggacatagaaagtcccatatttcgaggagaagtctgtcaattgagctcggaccttccttttctcctcttgcctcgcagcgtggagcattacagactgaccttcctcgagttttttcatcctctcctcgcacgcaagaagttcggcccttgatcggttttcattttcaatggtcgtcggataggcgttcttgcccgattcgagttttgcggagagatcggtgttagaaatctcaagagtttgaaccttagcttctgcggctctcatacggctaagtacactattagcccgatccaccatacgagcgttctcctcctcgttttgcttataactctcaatctccttatccttctcgaagagctggtcctcgtgactgaggaaggcatagttaaactcctggacagcctaataataaaagtggttagggaatacaaaccagtgagaagtgaacttgttttctgataaagtttatttacctcgccaagtttctcccggttggttgccttaagttccgctaggggtggcatgatcgctctggggtgaacgagtgtcctaagcgtgtcagcgaagggcatcggaggagctgagacaattcaaaaaatacgtataagtgattgacggattgataaaaccttcaaaggcaacgacttagaacacgagcttaccaggcaaaggagatgtggtgcgacgctgcgagtagcgggactcagacaccctggaggagagaacaacgagatcttgcgaatctccctttttgtttttccccttctgctggttttgaccagtctcttttgcctcatttccggcgcgtgaagagcgggaaggagagcgagcatcggtctctgaatgcttcctcttcttgtcagcatcccgctttgtgggctccttatccggagtattcttgttcgacgtccttgcctccgaggtggagatcttgggaccctttccggacaaagcggaagacttctgacgagttccggagtcgtcctcattttgaggctgcttggctttgtcgagagcacgaagtttgctgtcctcaagagttccagccattaccaccttgtctgactgaagccgctccttttctttcctcgccctttctctttccatcttcttctcagcacagtacgaggaggatgccatctctgcttcggagaatattcggggttgaaaaggaggtgaagaggtagcagtcctagagcgaagtcttcgccctcatgctcgaattttgtcgtttgtcagagcttcccaaactaagtcttgacgacagaaactggagaagtgagcagcgaaggttttcgagataggggatttctcaactcgagctgcgaaaacaaaataaaacgttgatcagcttgtgaaaacaaaatttttacaagttcaaaataaatcatcctaaggtcgccatctaccagctcgagcagcccattcataaacaaagagatcggtcttattcccaaaggtgagctcgtttacgaggaaaaagaaaaaagattttctccagttttcatctttctctgcgaaatcctcaaacacacggaaaccttttcgaggagataagaagaaggtccctgtccccgaagtgcgaccttttttcacagcttatagttgaaggaggtcgggtagtgaaagaagaaatccatcttcttctgccagagtgagaagacttaggatggtgcgaataatgttcggacatagctgaggcaacgctattccgaactcatgcataaactcgatgaggatgtcaggaagagggaagtaaaggccgcattccgagaagaaaatttcgaatgcgcaagtatgtccagcagggggagattcgggagagtctgtcggttcgggagatattaaactgatttgtgtcgagatctgatgggcccctctaagtaaggcgagtcttctcgaggttgaaagtgaggttttatatttcccgaactgaccctcgatcgagtacacctcgcggcttattttcttcggaggcatgacaaagaccaaagacttcggggattctgtgaaagacgatctggaggctattcggttcagtaaaattcaagaacacgatgaagatcttcttcagtgcttcaagaacaccgaaacgattttcgccgagatctgggaaataagcggttgtgccgacggtgattttaacgagaaccgcagcggagagagaagaataacagtggcaaatagcgaaaccgtcggaatcagcgctgaaaatctatgaatcgataaggattttcgatcgaggaacaccccgtttaaaccctaagcgagcctaaactaaagaatttccggcaagattcatagcgtctaaagaacagaagcagaaacagagaaaggagcgagagaatttacctggaaagacttgaagatgagttgctggttcttataaatgaaagtgaagaggacgagggattgatttgattaaatagaggacgaacgagcgggaaaaaggaaaccctaggatcacgaaatgtcacactcttcccgataaaatctcaaaactcgcggaattttatttcctgttttacctcgagcctatgcagttaaggaaagaaatcccgagctggcgccgtaattgctaggatcacgggctgaaatcgatttaagtctccgaattgatttctctctttcaaagacttggggggtaaaatgtggatgtcggatctcatcagtttgccccgacccgagatccatcatcatcaatcagtgggctcgaaacggtgggcctgaaaccacccgtgacgaagtgggattcgagggcccattcgaggcccagtccgcgtaagagtatctgggctttacgtaacaaaaaatcactggagtaaatgaggatgtgttaatacgcgaagtggcagttcaaaacgtaaacattaatgaggcatgattcgcggtgtaattcacgcgttcatttacttcgtaaatattccatttgattgtataaatagaactcgatcatcatttgtaagggggaaagaaaaaattactatacaaaagaattccgattaactgaaatattgtccgatttaatcttggctcgactaacaaggtttaaggtcctcgtaacatccacaacttcctaattgcggattccgacatccacaagtgccacatctgaaacaagcactctcatatttttgggaagtatttgcttggatttcttttcctttcgaatcatgctcaagacgaatccattgatatgacttcctggtttgttgattaaaccctcttccatgtccgcgatagcttcggcaaccacgttcccaaaacgttttgttttctcttactggatttttaacatccaatgcattcacctcagggaatgtctttgatccggtaggtcgggacatgtgattcttgattaggagctcactattcttttcggctattaagagctccacaatcaaatctgagaatttggtatatccacgcaacctatattgttgttgcaaagtaatctggtttttgtgaaacgtggtatacgttttctcaagcatctgggattcagtgatagtttcaccacaatatctcagtttggccacgattcccaacatggcagaattgtagtttattaccttatcaaagtcttggaaccttagactttgccattcctcccggacaagtgggagagtgatgccccttttatgatcaaaacaatctttcaaagatttcaaagttctttaggatctctcatgtgtgcatagtcatatatagcactttcatctcggtgtcttctaaagaagatcaccgattttgtcttttcttggaccgtcgaagaattattctcctttctagttttcgttatcccaaaggaccccaaatatagttcaacattggtagtccaagatatttagttagccccggtatgtctaaggcaggaaattggagcttttcgatatttgccatttcgtttcttaaataaaatcataaagaactttattagaaatttaatttatttcatttcatagtatgagaggtacttgaataagcaatgcaatttaaaagaaatacaattaactaaaaaggtaaaataataaccatcaaaatttcttcgggagaaaattctccaaagagtaaaccgtaaattgcaacaattataaaaccaattacaaaaactaaaaacagatgactcatgcttaaagagatgattttaggagaagatgaaatctttgagtgagatgaatgaatgagaaataagagtatatatagataaaataaactgttcactagcagttaagtagccggttgaaaaggaaaaaaaaatttaagagtttgggtaattaatttcatttatttatttatgaccgttaagatttaaaaaataaaattttagtctaaaaataaataatcaggaaaatatatattaatttatacataagattatataggtgtttgagcctccttttataataatgataatataaatgataatatgataatgatatgttggctaaatcatccatatgaaaaaaaaattaaaagcagcaaataaaacatatggtgatttagatcatccatgttaaagcaataaattaaaatattaaataaaatatggtgactaaaatcatccaagttaaagcagtaaattaaaatattaaataaaatatggtgattaaaatcattcttgttaaaactgtgaattagagtattaaatgtaatatggtgattaaaatcatccatagaaacaagaagtaaattattgtgactaaaatcatccacattaaaaagttaaaagcaataaataagatggtgcattaaataaccatataaaagtattatatttataaagggcggcagaacagcgctctgataataatatagcttaacatggtggagtgatcatactgataacatgttgtattttaatagaattttgtaccgtaagtcatctatcaatttatcttcttttcaagttttaaagaaaaataatagacatattgtaagagaaagaaatatgagaaagaaagcaagcataaaagaagagtaataatagaaaaaactttacactaattttcttttatattcagatgagtatctttacaactaaatggaagagtaaggtcatgtttatttctccatctagatggaccatctagatagagatgaaaaataatgtttgttttggcatttaaatgaagaagttgaataatacatctgaataggtttgtaaatttaggcaaatttgtgaaactcatttggatggacttgattaaaccatttggatggagatggttaagccaaaaagaacaaatgacaaatataccctcttttaataatgttaatttattatagattttttatttaacatttttttaaattacatattgcattccaaaaatcatgaaactacggactattatttaacgtaaaaaatgtaaattcattattcccgcctaaaccgcaacatcatgtttttcccgccaaaaccataaaatcatttttctcgctaaaaccgtaaaatcatgttttccgccaaaacagtaaaatcatgtttttccaccaaaaccgcaaaatcatgtttttccaccaaaatcgtaaaatcatttttccgcccaaaccacaaaatcatgtttttccacgaaaacagtaaaatcatgttttctccgctaaaatcgtaaaatcattttcccgccaaaaccgtaaaatcacgttttctgccaaaacttctcacaaaaactgaaaaatcatgtttttcaactagaatcgtaaaatcatttttcccgccaaaactgtaaaataatgtttttccgccaaaaccgtaaattaaaatcacgttttcccatcaaaaccgtaaaatcattttttccaccaaaaccacaaaatcatgttttccaccaaaactgtaaaattatttttcccaccaaaatcgtaaaattattttcccggcaaaccgtaaaattatgttttcccgccaaaaccgtataatcattttttccaacaaaatccaaattcatgtttctcgtcaaaacttcaaattatatttgccacccaaaaccataaaaaaaaatattatgctaaaaaccgcaaaatcacattttccgcaataattcaattaatatagctaagattaaagattaaaaagttaatatgtttggtattgatatttgataatgacgttgtatatttttcaaaatgagaacatgggattttaatcatttttttctagacgagaataaagatgaactacaaaatgatcaaacaaagaaatatcaatttaaatgcatcatttagataataaaaaaaatgatgaaacaaacatcattcagatgcatcatccaaatggatcatgtaaatgaatcatttggatgtaaatgctaaatgatgaaacaaacaggacctaaatatataacacaaaaataaacaaataatactataattgataaataaaaatggactccatataatatttgatagacaaatgtttcttttaactttattataattaattggctcctattcaaaggtttgactgtttgagcccaaaaaaaaatgaaaaaagaaaaaacttgtaatctccgttctgtacagtgaaacttcatcttcttctagaatcaaaatctagggttctgatataaccctatttttactgcttttagctatgatttaggtataggttttagagtctatttgttatttctagagttttttttagttttttttcaggtctttacatgtttgagattcatttggagataatggagcattctagagaaaaacagagaatttatgctgcataagaaatccgaagactaaaaagcgcggaggtgtcgagcgacaccaatacctgatggcaattcgatgatgcaacttattgatgttttgaagatttccaaattcggctcagaactttctcctatgtttaatgaaggcccatcacgtttttaagacatatatatagcttttaggtcattgtttagacctaagcttggagaggcttatctccttatctcttttgtactttgggagaaaaaccctgtggagactccctttagagaagatccttctaaaccttaatctcttcttgttttattcattgatttcttattcaatcatgttgtttgcttcattcatcatgtttgagtagctttttggttaggtttagggtttctcattagggatttagatgatttagtagattgcccccttgctaggttatctgtaggattcttcttcttgattgttcttaatgctagttctagagtagctaaacagcacttgatattagataataggtatacccaccataggtacttgttattgaactatcatagatgagcctatgcatttaagaaagaacatgtaggctcatagaagggctctggtttagatactaggtgaactaatcaaacttaataataatgcatgctttagtataggatttctcggcttctccggttatcttagctctaagtatagagagttttgcggaacaccaccggttactctaaaatcatagtttgagttcgagaacggtgcgataacaacctagctatttctagatctactatcatctattttctgagaataccttaagcctgacgcttttaatatcttgtttcacaaccaaccaatcttctattgctcactttttgtttctctttattttctttactattttacttagcttaattcgatagccattatctattgcgttgtcagagaactttatgaattcgatccctaaatactacaactggcctctttatttgagaaagtggtcttaggattaatttgacctatattaggttctagatttatctcttcgctttttttgggatttcttcttcttcttcttcttcttcccattgatctccagcttccgatcttctagaaattttcaatctttacacatttcgagtaaaaaacaaaaaacgagtgaaaaccaaacaaaacccagcttaatcaagctcgtcactcggtggaaaaaaaaaaccttattttaatggcgaaaactcgacctggtgtcgctttttcttcaaagattaagctgggcaagaaagatatcaaaattgttagatgcaagttctatgtgcattttgtatataactaatcacttttttgattgcttcttttgagttattaagctgcaattagatttctatagactcatttcaatctgaaacgaaaaaaaatctcttcttttataaaaacttatgcttgatgttgattcaatgaagttgagttatgtcattgcttaataagtacactttggtaaatgtgatctttggtagattttacgtttttttggagttaggaagagaaattttacttggaaatgtgatagttgaggtgggtttttttacagtgggagattgtgtgttaatgcgtccatcagatgctggtaaagctccttacgtggcgcgtgttgagaagattgaagcagatgcaaggaacaatgtgaaggtgcattgtcgatggtactattgtcctgaagaatcacatgggggaaggagacagctccatggagctaaagagcttttcttgtctgatcacttcgatgttcaaagtgcacacaccattgaaggaaaatgtatagttcacacctttaaaaactacacgaggcttgaaaatgttggagtggaagattattactgtatatttgactataaagctgctactggcgcgtttactcctgatcgagttgctgtgtgagtggatacatagtaatgaaacatgcctttttctcctgtagtttacatagagttttgatttatcttcttttggattttgataaaggtactacaaatgtgaaatgccgtataactcagatgaactgatggtgcaattaatgtgaagggtgtaaggactcgtaaatgctaattttcatcattctattttcatcttctttttatttcaagtattgttgcttaactagtaagatatctaatgctgaattctgatgattataaactcttagatatttgttattcctaatccggaacaacttgcttgtgtaaattttggatagaaatggtctcctctctgtttgaggtctaatcgaaatagttattgcataatatgttctttttattaaattgtaggagttactactatgtcattatagggttcacctagcgtgtgtaggcgtgacgattgaagaagccaagaagctggaacactttgtatgtgttgaatgcagctctgacgaagatggagtcaaaagatttcagaacgggtttgcttcatcaacaaccaatgatcttaaggtatatgttttgtcttcttctttttattcaacttttgttattactttgatactgtcatagcaataacctctgccaccatcattggctctactttttaagtacttagtaaagtcacaaaaagcaaatttcattggcttgatgtttgtggctaaaaaaataagatatgtgactcgtacattgttaatctcttctcttatcctgatcaaatccgattgtttttactgttttacctgaaacaacatgttcttgtgttaacaaaaaacttgtgtgttcaggtggaagccaagcgccgaaaagatgatcgatgtaagagcctcttatgagttatgagtggatagtatagtttacttcaagctctttgggagcaaatttaagataattaggattttgtgttctcgtcgtttgatgatgtgaaaagagaaaaaagagagaaagaagaaccagagaatgtgcaaagagcagtatagccgataatttcgtggggataacatataaaagtttcaagcacctgagattgttttactgtggattgattgttttgagagagagattctttgcacacacaaaaaagaaaagatagagagagagattcaagacatgagctgatgaacacatattgcctctgggcttgtggccaacataataagtaaatatcagatccccactcctcagagtctgataatcaggttgagttttgtcatacgaatgcgggagtgtgataatttggtcggtttcttggtgattaagagataagccacacctaaacctaagtcagagttggaatacaagatttattactgaaaatttcacttttaaatttagaaagtacggaattattgagtaagttatttgttgaatttgtgactggaagcgttttgatgcgtcatttgtcaatctacttgattagttacatttttaacacatgatacaaattatgtgattgttgagattggataattaccactattattatcttcttatcacttactctctaataccttgttctccaattaactatagcctatcctattatacaaatctacctttcttcccaagcaactctaatatatatacgttagttctctttacttcagtgtaagaaatagaagtcagtaataagaagtccatttcattactttctcatcactttttttttttgtcgtcaactagttttttttacataaaggtgaattggagcccaacaacatatatctaactaaagcccaatcttagacccaaaacaaagatgacaattgaaacatagggtaagaaaaggacacgtggataaacatgtgttgcacaagttgggatggagtcgcatgacgacagatcaccgccatctccaccggcacggaaccaccgttcagatgtaaactacaagaaaacctgccatttgcaattctcatattggtcccaaaatgatcgcaaactaggtgtttacgactacttaacgacgataataaacggtcgcttaaaaactgtcgcaaaatattgcagtcccaaatcggtcgcttatcagcgacgaatttcggacacataaggttagtcgtaaataagcgactgatttgtgatgggtataaagaagtggcagatatgcgactaaactgcaacaacgtacatttaggtacatacgttacaatatagtcgcaaaatagtctttcccttttgcgactaagttacgacgccttgtaatgtaatcgcaaaatagtatcgttttagcaacgattgtgccactatgtaacaattttgtgtaatttgatttagtcacaaattggtcacagttttgtaatgggtcggtcacattattgtcacatattttgaataagtttggtcacaaagtggtcatagttatataattggtttggtcacaaattagtcacatgtattgttttggtttggtcacaaagtagtcacatgtattgttttggtttagtcacaaattggtcttatgtttggaatgataaacatgattaatatcgattcaaaagccaataatccctaatcatgttaacattaagacactaattatgtttacattcagaaaatcatagtcatagaaatcctaaacaagtttcaacaaaaacaacaaaagctacaaaagatcaagtttaatggttagaagaagtgttagaaatagtagctaaagtggagactaagggtgtggtgcatgcaactgtgatggctggtgcgggggttgtggtggttggaagtgtggatggagttgtgttggttggatgtgtgtctggttcatgttgagtagaatcagttgacaaataagcagccaactcaggatcttttttctttcatgaagaggacgagcttctccaagctggctatccgagattgagattggcgatgctcctcatcaagttttgcattttgctcctcttgttcagatatcttgagctgcagctgctcttgaagttgcgcaacagttgaagtagaagagcttgcataactctctttcctttttcttttgttcagtgtctctagaagcgatccaaggccaaaagggttccctttgtcatctatatgagtacactgaaacaagaagacaaatacaatcaccaaagacaatcataattactctaagtatccattgctcataatcaatcatattccaagcaaacaaagacaagcagattgtaagcaaaataaaaacggaaatgaattaccttaagaaaaatcttattcttttcatcaatgatgagcgtacgatgagttgaatgttgcgaggaattatcagacacttgaggaccatcctcatccatttcagacatcctctcttccagtatcttcacataagcctcaccaacatgctgagatttctgatctacaaaagatccatcaacccttgtatgtgtttgcataaacacttccccatatgatacatgacgcttcaaacgttcctcttgccaaagaaaatcaaatagacaaagacaagcttagacaagcctatgtggaggtaattatagaaagctgttaagtgaactgtttggatggaaagaaaactcttaccatttcttgatgaacttgcacaaaagatttctgaccggctaagtgtttgtgcactccaagacctccacgatctgagtttctacagtttgaagttgtctcacttttcagctgagcatcttcagtgttccaatgcacccacatttgtttccaaagtgtatcacgaatccatggtggttgttcaccactcttctttgcttgactgacaatccctttcatccttttcttggctataaccaagaaactttctttaacgagttcagtaatgccttcatcccaataatacttccgctacataacaaacagctaagttagcaaagatagtaagagcaacactaaagccaaacaataacagaatgaaaggtatttgtgacattaccgcaaaatttctgaagtatctctcttgagtggctattggagtaacgttccaactgaagtaaggcccatcacttcgtcctaaatatggttgaaatcactttagacaactttcctttgtgctagttaaacctgcctatgttacttttgattaaaccaccaagacattccaaatataaacataatcgactttagttgatgcaaccaacagagaattagcaaaaatgaaatggttttgaaacaataacagaaaacaaaaactcacggaccaaaacaaagactgcagattaaaacaaagactgcagaccaaaaccaaaactattttaaaacgactttaggtgagctaacacttaacattaccaacagaccaaacaaagattgcagaccaaatcgactttatgtgagccaacacaaaacaaagacaaggagaccaaaacttttgactgtagaccaaatcgactttaggtgagccaacacttaacaaatacaagcagaccaaacacagactgcagaccaaatcgatgaatgtgtgagccaacataaaacaaagaagttcagaccaaagaaagactgtagaccaaatcattgcactagagccaacactaaagccaaataaaaatttgtctagagccaacacaaaacaaagagtgcagaccaatacaaagactccagaccatacttagcttaatcaccattcataatcttcatctgtttctagaaggagagaaagatagagcttaccagagagtctcgacttctggaataggctcctgagacagaaccgaaagttgttgtcggccaggcagggcaagtaagcgatccaacagctcttggtagtcgacattagggttttgttcttctttgtcgacttcctctccatcttcttccccgacttcctccctatctgtttccccatcgtcctcctcatcttcctcttcatgattttgaagttttggtatgaactgtgtctccggtggatcctgagcaagctgttcttgaagatgaggaatctgatgttgacgagcaggaggtgtggttgctttcgacgaataagaagcggttgttgagagccaaattgcgagtgagaacgagcaggagtcggggtttgtgtcgtttggggtggtgatttctggggtcgtgtcgccggcagattttgggaaggaagacttctatttgaatgtgtaacggagagcgtcgccattagggtttgaggacagagaagaacctccgacttcactcccacggccgagaggatttttaccgtaaaaaacctttgccttcggcgtagattccctacctcgacctcgacttcctgacgattttcctttaccaccaccagccatagttcaaattcgagtttacaaagaaaagaattccaaaccctagatctagaatttgactagagaacaagagggtttagagaagagaaattaagaggattgaaaggtattttggagagtattctagagagaatgagaattgaaaaccctagattgagaaaaggaaacgataaaatgagagaagtcgacaagtttatttccacttaaaataaataaagagtcgctctttggtccctcttcggtcgaactataattatgcgagaatcacttaatatattttacaaaattttaaaaacgttgcacaatcgtcgcaaatcagtcgcaactcggttacgcaaacgtcgcaaagtgtgactattttgtaactattagtaaaacgtcacaagaaaaaaaaaatccacatagtttgatccaatctattgataaatattactgaaaagcactcattttattacgtacagaactttaggtatataaatgattggtttcataacttattttagaacttgtttgaaaatatcaatcatgacaatgaaaactcatgaaacttatcatatagattatgtttttttggatgtatagtttgtaaaattcagacttgaagtgtttggttatgtttgtatatctaatatctatcaaattaaagtatcaacgtataagaaaacatataaatagaccaaaattttaaaatttcgaaatgcaaaaattgatcgttggtaatacgtaggtaattggttgtaaagtgcgactgttttctattttcgtcgcaaataagttgcaaagagcgactattttgtgacatttacaaaacgtcacaagacaaactttttaaatccacatagtttgatccgatctagttctaaaaattactgaaagcacccattttagtgatatacagtacatacagaactttagacatataaatgattggtttcataacttattttagaacttgtttgaaaatatcaatcatgacaatgaaagaacatagaacttatcatatatattaggtttttgtgaatgtttagtttgtaaagttcagatttgaattgtttggttatgtttttatatctaatatcgattaaattaaagtatcaacgtataagaaaatatataaacagaccaaaactttaaaatttcaaaatggaaaaatccagagttggtaatacgtaggtaattggttgcaaaaagcgactgttttctaatatcgtcgcaaataagttgcgaagatcgattgctttgtgcaaaaatcgagtggtggtagttacgtaggtaattagttgcaaatatgcgactgttttctagtttcgtcgcaaataagttgcaaagatcgactgttttgtgacgtttaggaaatttttacaaataaaaaaggattcaaatggaatcgaatcgcgagcgtgtaagttggttggctagtatgttagcaactgagctggttacaaatttgattaacaattgtgaagataattacttaaaaagacactgaaaattacattaaaataaaagttttatttatataaattttacaaatacacaaaaaaattatatctattctaattattcagattcttcatcttcttcttctttatcttcatccttggatgttgattcattacagtgaaattcatctccttcttgataacactgtattttactcattttagacatgtatttatcatcatttagcttagtgaccactcattgtatcatatcattttgcatcacatttagcttattttgcacacttaggcatttaggatcatcttgcatacatattgcatgttttggtgtgttttcaggtgcagaaggagcttacaaggaatctactcgaccctctactctatcaaaccaagagggaagcagcaaagcaattcactcgattcctttactcgatccaggcagccacaaaggaggcagcagacacccctcgaccctcctactcgatcctctactcgacctctttactcgatcaagggcgacctagtctacaagacttgttgatcgttcaaagcgtcttcggatcttcctcattctccactggaccagacatcttagcatacagataggagaggaagaagcatctactcgaccaattgatcactcggagcatggaggcaaaaggcgcagactttgctccaccctctttactcgatccccaagatcgagcatccatccaaaccgcctcaagtctcttgtcttctagtgaatctagggtttttgagactttagtataaataggtcactttgggatttgtccaaaggaccaagtttttatctcttagtttttctttgtgttcttgaatcttaaaaccttaattactcttaatatatttcgtttttgcatttagttctttgagcaaagttgtttatcttgtttagctctacattttgatatgatttgagtaatttttgggtttgtgctcttgagtatgttgcttgagtagtgattagggttcttgaggatggattagattatggtaatctctaggttagtcaggtggttaagattaggttagatcccttctggatttgttggcccctatgcggtttttgctggctaatgtgggaattcgaccataggtatccagcgtccaaaagacattcatatggatgtctgatctacgaattccagagatttgtagattatagcccaagagattggatgtttagactgcttattgactttggtagattgttgcttaaaccctgctcttctatgtttcatcaacgagagttgagattaggaagtggtagagttatgggggtctctatcacgagagtggattgacccggtgtttgaatctatcgtctatggtatctgcctttcgcttgttagccacctaatgaaccctaaagttgcccttattaatgaatccatccttatgacttctattattcttaaataaaagtgcaatcacggggtgaatacaaataattatttgtattcaccccctgattgtacttttatttacttgttatttcattcacctgttgattgcatttttaattcttaaatttatcacctgttggttctactcgacccaatgatcgagtagggctcttaagttctcatatttgttgtttgaatcctgacataggattgttactagaaacaaaccatcattataatctggcttgacttagttgcttctttgcacatcttgatttctagcaataacagtggaccggattgataccccctatagctgcatcgacatgttagtgtttaaggagaattgaactgaacacaccaaacttcaacacataagtaggcctaaaaaacctacttatcaatttggcgtcgttgccaattcattgttgcattgttacattcaagatatcagaaaaagttaagatcaagttctttaacaatactctaagttactaactcatctttttgtctgcttgtttttgtggtataggtactaatctttgtgcatgcaaactcggtccaaaggttctgcacacctactacctttcaaagacataattgacagaatagctcgtgagttacaagaaaccaaagcaaaggcagactgtgatcaacaaagccaagcttctatggatcaacaggacagaccagttgatgttcaagacccacctatagttgatcaaccaagaaacattggtgctggtgatgccccaagaaatcatcaccaaagacaagggatagtgccaccaccagttaagaacaacaactttgaaatcaagagtggtctcatcttcatgatccaaggaaacaaatttcatggtttgactatggaagatcccgtggaccatcttgacagctttgataagctctgtggcctcaccaagatcaatggtgtcactgaagatatgtttaagtgttacgattcatgctcacagtcactctgattcaattctctctttaaactcgttgaatctcaactcaagaacaaaattaaaagcaataaacgaagaacacaaatttgttacccagttcagctaatcgatatgattaagcctacgtctggggccagattcgatccggcaatccactaacacaaagaagaagaatctgctcaaagagctttacaacaatggagtctctcaagctctctctctctctctctctctctctctctctcttacttctctctctcaatagcagagataacagaatgaataaagaagaaaataacaatttatgttttatacttgaaacaacaaaaactctatcgcgactagaggctttgacttcctacttttcttcttcaattgataaccgagacaaaccgaactaaaccgacttcaatctccaatcaatttctaggttaaaccaaaccttaaaactgaatcagaaaccaacatcacaacactccaccttgattcaagtttctttctccttcaagtgaattgcattacttggatgtaacctctggttttggcgaattctcgcctgtttacctgagcagcttcaggaactccaatgctgcttcaaacttcgaaactggtataccttttgtgagcatatcagctggattcctagtcgtgtgaatcttatgaacttcgacttcaccagcttcaataatgtctctgatgaaatgatacttcttaccaatgtgctttgttctttcatgaaaagcattgttctttgataaacataatgcagactgtgagtcacttcacacttcagcagtctcagttccaagcatcatatcatccaacaagtttcttatccacatagcctcctttacagccttagtaagagctatgtattctgcttcagtggttgacagcgcaacaactggttgcagacatgacttccagctcacaatgttgcctcccactgtgaaaacatatccgctaatagacatgttcttatcaaggtctgcagcatgatctgaatcgcaataaccctgcactttaaaatcaaatcctttagtatacatcaagtttaatcctattgaccatttaagatacctcaacaaccacttgactgctgtccaatgtacttctccttgcttgctcataaacctgctaactagtccaatagcataagctatatccggtctagttccaatcatagcatacatgagactgccgacaacactagagtagggaactttctcagaacctactctttcatcatcgttatgaactgatgacaatttgaaatgagcaccaattggagtattcacaaccttagccccatccattctgaacttctgaattactctttccaagtaactagtctgggacaagcatagagttccttcactcctattccttatgatatctattcccaatttcctacttgcagctcccatatccttcatttcaaattctctactcaaaactttcttaagctttttaatctctgtcatactcttagctgctaacaacatatcatcaacatagagcagcaagtagacacattcaccattgcttacctctttaacatagacgcatgaatcactcacacttctactgaacttctgatccatcatgaatgcattgaaccgcttattccactgtctaggtgcctgtttcaggccataaagagatttctttagcaaacatacttgatctagttcaggatttacctcaaagccttcaggttgttccatgaacaatgtttgatcaagttctccatgcaaaaatgctgtttttacatccatctgttctaattccatgtcctctttaaccattagggatagtaagattctgattgatgtgtgtttcacaacaggtgagaacacttcttggtagtcaattccttctctatgagagaatcctcttgctaccaaccttgccttatatcttggtagctcaacaccaggaattccaagcttcttcttgtacaaccaatgacagcttatcactttttgattcttaggtttgtcgactatatcccaggttgcatttttcaacagagaatccatttcttctatcatgcctccatgccatttttcccagtctttgtcttccttaacatcatgaaaacatactggttcctctgattcaacttcttctgccatgactagagcaaaagcaaactgagtatagtcagtaagttttgcaggtggtctaattgttcttctgaccctatctctagccaactgataagtcttcagattgcttcatgtaactactccttcaacatcattatattcatcttcagaatcattgagctggacttgagtagctccaccttgaacctgattctgtgtttcaagttctgattttggcggcgtttcaatctcaatctgagattcctgtgttactgtttcatcttcatctttgcttcctgactgtaagtccttgaacactgaatcttcattaaacaccacatttctgctgataacacatttttcttcatcaattaaccacaccttgtaacctttagtgccttgaggatatccgagaaacactcctttcaatactctcggttttaacttgccttgttcttgatgaacataggctatagaactgaatcttctcaggtgcttatatccaggttctctgttgagccacaactgctctggcacattgtgatcaactgctgaagcaggtgacctgttaatcaagtatgcatctgttgctgcagtctcagctcaaaacgtttcttcaagacctgattcatcaagcatgcacctcaccttttccattattgttctattcatccttttagtcactccattctgctgaggagtataggtacacgtccggtgtctttcaatgccagtcttggcacaatagtcattaaatctgttattacaaaactccaatccattgtcagttcttagagttttgaccttctttcccacatgattctctactatttccttccattcacagaacttatcaaatgtctcatctttcgatttcagaaacattaaccaaacttttctagatttgtcatctataatggataagaagtattgtttacccgagatagatggagtaacatttggtgatccccacaagtcagcatgaacatatccaagtatgtcttctgtaacatgtttaccaacattaaaactgagtttcttcgattttcccataacatagtgttcacagaagtccaagtccttgaattcctttttctcaatcagtctgtttgccttataggatcttcatattatttatgctcatgtgaccaagtctgctatgccacagctttgtgctgttcttagcactttctgcattgcaggtttcagtagctactgtgtgtccatccagaatatagagaccgttcatcaagtatccacataaagcagttttgccattcttgtagaatctcagttttccttctccaccttcatgtttgtaaccaagagagtgaagtgtcccagtagagatcaagtttcttcttaggttaggaacatatctgacatttttcagcattctgattaaacctccatgagtgttcaatttgatggtaccacatcctcttgattctactgtgtgatcatcacccaaaagtatcattgttgctctattctcattttccagcttcttctttctcgcaaaacaatctctcttaacatgagcttcctttttacaaaaccaacaagtcactcgcgttttagagttagacctacctctattctttccttgaccttgcttatcctgattcctcacttgaggtctgcctctatctgttgtgtagagagccatggacacatttttgttgctttcttgagtctctgataactttctctcaagtgacttggcggatgataccacatctgtactgagagagtcttgttcccatacttaagagtatgtttaagttggatgtaactagatggcagtaaattttgatcaagacagcttgaacctcttttccaacatagattgataaacttcctaactcagccagaatcctcaaaaactcatcaacattctgatcaatgctcaaagtatcaaccatcttgaatgaatacaacttcaattgtgtgtatattcgattaagcaaagaagtttccatgaacaatttgttcaatgttgcccagatctctgcagcggtcttacagtgttgaacctttaaaagaactgtatcagtgatgtgattaatgatgaagttctttgcttgttcagactgctcaaacttaatcggatctggttcttcagtagcttgctttatatcagatgcatcatcttcatattctgattctttttcctctttctttgccacaggaactgtcttggtcaatttaaaatccgtaaggctgttcttcaagcctagtacgccgagctgagcttctattcttatcttccaaaacgagaagtctcgatcgccattgaaggttttaatctcgaccttcatcgtcattaccatcgagcgaatctttcgaaccaacgttccgataccactttgttacggttcgtgctcacaatcactctgattcaattctctctttaaactcgttgaatctcaactcaagaacaaaatcaaaagcaataaacgaaaaacgtaaatttgttacccagttcagctaatcgatatgattaagcctacgtctgggaccagattcgatccggtaatccactaacacaaagaagaagaatctgctcaaagagcttgaagaagaagaagaagaagaagaagaagaagaagaagaagaagaacatcaagtctttcttggaaaagtagacccaattctacgttgacaatgccgtggaacacccaattcaagctgtgtgcaccctagctcatctacccgaagaacatcaagtctttcttggaaaagtagaccaacattggatccctcacacttatgaagaagctataactcatcaagtatggagggacgctattgcagccgagatgagcttcctagaggtaagaaaactgtcacctcgaagtgggtcttcaccattaaatataagagtgatggggagattgaaagatacaaggcaagacttgtggcaagaggatttactcaaacgtatggggaggactatctagatacgtttgctccggtcgcaaagttacatacattccgagtagtactctccttggcgaccaatctcgagtgggatctttggcaaatggatgttaagaatgcgtttcttcaaggagaactcgaagaagaagtgtacatgaagccaccaccgggtctagaagtcattaatgctcccaataaagtctttaagcttaagaaagccatctacggtttaaagcaatctccgagagcgtggtaccacaaactcagcaccacattgatgggaagagggttcaaaacgtctgaagccgataacactctcttcactttaccaagccaaaaaggtatagtagtcattctcgtatatgtagatgatattatcatctccgggaatgacaaggtaggtattcaagatacaaaaacttttcttaaaagtgtttttgatattaaagaccttggtgagttaaaatatttccttgggatagaagtttgtagatcaaaggaaggtctcttcttatcccaaaggaaatatacacttgatcttcttgcccaagtaggtaaactcggggtaaaaccggccaagactccactagaggacgattacaaggccaaacgaaagggggagcatgataacaaaccatttgaagatgctacgagatatagaagacttgttggtaaacttatctacttaaccataacctgacctgacatttgtttgctgttaatgtagtaagttaacacatgcaagctcccacaatacatcattggaacatggtgaatcacattctcaaatatctcaaaggagctccgggtcaaggcatttggatgggatgaatagaaacacggagattgttggatattgtgatgcggattatgccggagatcaacaagataggcgttctacaacgggctattgcaccttcattggaggaaacctagtaacatggagaagcaagaaacaaaaagtagtgtctctctcaagtgctgaagccgaatatagagccatgagaaagctcactactgaactcatgtggttgaaagctctccttaaagactttggcattgatacaccaaaccccattccaatgcattgcgacaatcaagctgcaattcacattgcctctaactcggtgtttcacgagagaacaaagcatattgaagtagactgccacaaagtacgagaacaagtacaactcggagtgatcctaccacattacactgagagtgaggaacaattagtcgacgtcttcaccaaaggagcgagcaccaaggtgtgtgaatatattcacaacaaacttggcgtagttgatctaaccaggccatgatcctcttatcaaatatcccatactctttttcccttgtgtgtagttttatccaaagaggtttttctacaccaaggtttttaatgaggtggttgaatttggttccaagcttaatctcgactcatctccggttaagcttgagggggagtattgaacctaatgaaggaaaccccttccgcaagttaaactagacgaccatacggaggaagagaagcccatccgtacaacatcacaatgagagaagcccatataaactcttcttcaccttaagctcttctagaagacctagaagactcctcatgtagccgttgaagcttaagcgcccaagtcaaaagaagatcgcatgtgtttaaagcaaactgaacgttaggtcatgtctctttcttagtacgatagtgacttgtctacacgatgtggacttgtatagagtgcgacgtgtttagcatattcttaggagatctttacttacctaatgtccatatatagcttgtatcttatgtatgtttttaataaagaaatagagaaaatctcttttctcacaatctctcttctatttccgcaatactatctcttccttatgttcatttctcactctcaaccctcttaatcaagagtcccattcttgcaacctaaagctccatattcttacaataaaacacatcttcaattatcttcaaagtactattgatttaggattatattatcttagaaactttgagttttggaaagttggttttgcagatgcagtgtatttatcgaaccctcataagtctagatcacataccagatatgtttttaccattggaggaactgcaacttgtggcgttctcaaaagcagattttagtcgccacttcatcaaaccacccataaattattgctcttcatgaagcgtgtagagaatctgtttggcttagatccatgactaaccatattcaaaaagcaagtagattcatcatcaaaaaggagcaacaagattatatgaagataatgatgcgtgtgttgctcaaatcaaagaaggctatatcaaaagcggcagaacaaatcataaccctctaatatatatatatatatatatgtgtgtgtgattttaataaaaaaccgtgtatgactaaaaaataagaatataattttaaagaaatcacatgtgatcttaataaaaaaatatgtattactacaaaatatcttgataaagaaagatattaaactgaatataatatttttccaaaaaaacatatgctttttttaagtactatgtaatatgagaaaattaacaagataaaagaggatattatgttatcgcatatatttcggaaaaaaacatgctacaaaggatatttacgtaattacgtgtgttctacaacatgtttccgacaaggtactttagctcatggtttgtttcttatctttttttaaattcatggctagttaatagaaattccctatcatcttcttatcacttactccctaagtaccttgttccgcagttaactaaatctagctttctccccaagaaactctagtatatatatgttggttctcttcacttcattgtaagaaacataagtcaataagattatccacaatgcatgtgttgaattatttattcaattgttgaatctccacattgcacatattgaatatttaaaaaccttaagtggattcagcttgataaaaggtatgaaaaattatttctaatgcccttttcatgatgccccttttcaactttacctttttttatagctattttcatttctaccctctttaaatttttaatgactattttacccctatttggaaattgttttaggtaaacaaaatgaaatattaatatttttcgcctaaaatttttcaaaataatttttccgccaaaattttcccgccaaaaaaacttcgaaaaaatattcccgccaaaagtttttcgaaaaacaaaattttccgccaaagtttttttccaaatatatttttcccgcaaatttttttttttggcgggaaatagttttacagagattttaaaagggttttaaaagatttacaagtgattttaaaagggttttaaaatatttacaatggattttaaaagggttttaaaatacttataagggattttaaagggctgtaaaagatttacaaaggttttttataggtttttaaagggtttaaaattgttttaaaagggttttaaaatatttataagtgattttaaaaggttttaaaaaatttacaatagattttgaaagggttttaaaatatttacaagggattttaaaggactttaagagatttacaaaggaattctaaagatttttaaagggttttcaatccctgtaaatattttaaaatcccttgtaaatcttttaaaacccttttaaaatctcttgtaaatctatttctcgccaaaaaaacatttacaaggatttttaaaagtattttcttgcctaagaaaaaatttgttacacaaaaaaaattggcggaaatttttttattttggcgggaaactttttttttttcgggataaaagtttggaggaaatttttttttggcgccaaaaatttggtagaaaatttcaatttccaattccatgttcccattagatgagggtaatttggtcattctgttcaagggaaggggtatttttaaaaataaacaacacaaaaggatattgttgcaaaagggtagtaaaaaagggtagttttgcaaatctccctaaaagtattcaacagattgaaaaaaataaaattcggcctgtccatatcacgtttcagtaagtaacattttttataggatagattggggttaacttttattgtctaggtaagagtaccggagaaatatcaattttaaggtcaattgtttatattagtaaccatgttgcagataaatcggtagctaaaatgaatgttgcttcatgctttgtgtgtgtggttatctcaacggtgttagtcttatgaaactttgccatgaggggaatgatttagggttcgtaaatgggatagcttatgtaaccttatctattttcacccactattgtgaagcctactattttaaaatacttgggatcttcctatgttgggctgtgatattggtaaagaatattttgttcacctcttactgccgacgttgctccgaagctgctacaattggacttctagttcaacactgaggtggtggtggtggcgctggaggtggtggtggtgacgttggtggtggtggtggcggcgctggtggtggtggtggtggtaatggtcgtcgcagagatggagctcgacaccgaggcagaagcagagacttaagtagtagtgaggccgattctttccactcatcctggagttcgacttcggcaaggagtagcatatgattttaagtcgtcggtttggtctcctgatacgttttgagacttggtggtggtggtgtggaaagaagagtgtactgtcccaaactttttttttttttttaaatgaagagattattgagatgctgacacttgctatattttcattagatattgagattttgacttcatcttatctatttataatcacttattacatacaaaacaaagtttttaaaaatatatatttatatgaaaatttataactttttaaactatataaatagacaaattgttcatttcattcaaacaaataaaaaactgtcatttctactataattttcttattcttccctcataaactcttggttatatccttaattttgtttgaaataaattctaataataatcctaggcaaaattctattaactttccttttccctaccaaattccaacaataatcctacgcaaaatttggaatgtccgagattaaggagattttatatatgtgtgtggtgtgattgatgatttttattgtttgtgagttgaatcgcatgtgtgtttaatattaattgtgttgtgtgcttgtatcgtaatgtatttgaagttttaataaaatgtttttatttttataatctgataaatttagttaaaaataaaaaaataaaaaacagttattaaaaatatcatgtcacttttaatttatttaatttagttctaatcgatattttaactttaatttttgttcaacaattattattatacatcacaaaaatataatgtataagaaaataagaaaaccaaaataaaagtagtggggtagagtgttgaattttattaaacaaaaatattggagtgatagaaaattaagtggatgttgaattgtgatgtggaagaaagagaaaatgatgtaaagtgttgaaagctgaggtggagggtgttgaatatgattttacattgtacatatcatcttctacacattatgatatggaagaaagagaaaatgatgtggagtgttaaaagttaaggtcgagggtgttgaatatgtttttgcattgtacatagtcatttagactacttgcaatggaggtgttaaataaattattcaactgtttaatgggggtgttgaaaactaaaaaaataaacgtggatttttgattgttgaatctattcaacatgttggataatttttttttaggtccgcgcatgcacatgtcaccattttattagaaggtgtgtaaaaacacacccaaaaggcaagtaaagcgttttatattattattttctgataaaaacaaagagaatattgtgaagctgacactttttatattattattagtaattgagattttagagatttttatctcaccctatctatttacaatcaattattatgtagcaaatatatatatatttcttaaaaacatttatatgaaaattcataactttttaagctctataaaaaaaacttggttaatttcattcgcacacatacaaaaaaacaccaaatctatcctaattttttattatcctctaataaactcttgtttttcttctaaatttgatttttgtgaaatagattccaataataatatttcacaaaattgtacaaattttccatttttctatccaaatacaaccaataattctatccaaaattctaccaattatcattttccttatccaaatcctaataattaccaaatttaaaattcatctttcaaccaatcttaaaatatctcaaattatagttttctaccaaatttttctatgcaatcatttgctccaaactatcatatggatcgatgatgccatattcatctcaaccacctcctgaatttcttggattttctacacaaatgacttttggaaggatgagcgatactaatgaagacactccaaataatgatgatttaacttctacgctcggaaaaaccccaaatagataactgagcaaaatttggtgttattaggtggatggattaaatatggaatagacatcattgttggcagaaacaaaagagtgaatcatactgggataaaattgttgagtattgtaatgagcattgctcatttgatcctccacgtgatggagtttcgtgtagaaatcatttcaactatgtgaacaaaatattaggcaaatagattggcacttacgacaatgttaagcgtatgcaacaaaacgggtggcggagaatgatttatcggcaaaagcacataaaatatattcaagtggtaaaaatgggcatttcaattttatgtcagaatggcttgttgtccgtgatcaaccacgttatggtagtcaggtaaggggaaatattgggtctggaagcaatggatctaagagagtacactataatgatgcaagtgactcaaactctgtaggatttagtgttcatcccataggaagggatgcagctaaagaaaaagggaagggttcaagcttggaagtcgttaatgaaaagtggaatgaattcaagcaatttaaggagcaggagttggaacaattggaaaaatagccaaaaaacataaggaggccaaccaattgatgaagatgaagatgtttttgaagctagctgaaaatgagcatctagatgatcggagcaaagagctgtttgagaagttgagccatgaactatttgaaaattagtggttgtttagtgtatgtctacactttgtcactttctaatttaatgtttatgtttgtcatgtatgtttcagtattttatcactatgtgcaattatggttgtttgtcatttcgtgcaataatatttgtttgtctgtattccattattttccaacaatgtaacatatcgatcacttttggcttttcatacgagaatctaatccttatcttttagtttttcgcataatccttatcttatccctatctattggatttcaaccacatgatcttctaatcaaatccgcctcttattcttttctttcagccattcgattttttataaataggaactcattcttacattgatgaattactatcacaaatatcatcttactaaaataaaaatccaatggatccatcagaatttcccttcgatatcgaagcttacaaaagacaatttcatatcaaagagaggtatatcatcaaccggtttagagagcgtcacaaaaaaattgaagaagattatccacgtcgcaataaaagaacatatatcaagagggatcatgtagcaccaaactaaaggttgattgacaactactttgctattcaacctacgtatgatgatgcaatgtttcgacggtgattccggatgcgaaaacatgtttttcttcgaatcgttggagccttatcaagaaatgacgactacttcacccaacgtgttgacgaaacaaataaagaaggtatatctccactagcaaaatgtatcacggccatgcggatgttagcatatggtatggcgtcagacacggtggatgaatacatcaaaataggaggttctacaacattagagtgcttgcgtagattctgtaatggaatcatacaattgtacgagcaagaatatcttagagcttgtcgcatctggtccccatctttttgttttctactgcgttgaatccacgtatgattttttgctttttcaacaccctcattgtaagagttcaacagttaaataaattattcaacatctccattgcacatagttacatatgtcttttttcttctctcattacatttccaatggagatattgaatctttttttcaacagttgaatacctacaatggacttgttgaaaaaaacaaaaagatgaggtggattaaaatttagttgaatttgttcaacatgaaaaaaacctaaagtggagatcatgagatgtttgtgagctagtaaaaaattatatgcatttttagatttttttatctctctcctatttatttaaaaatcaattattttataccaaacaatttttttgtttatatttttatgtcaaaattcataatttttagttttctataaatagagatttgatttatttaatttgaagatattaaaagttcattttcttaaaagtattaaaagtcattttctaataacattttgtttatatcttttaaaaaaatcttaatagatcccaacaatattgtagttatggccttcaaattatgtagtttttaatcattttaatttaaactcaatggatgaatcattcatcatgaatgttattaatatatagttacaaaattataaaagaaaaaaaataagaagtaaaaaaatggtgggtaagatgtaaacttattaaacaaatttaatgtaaaagtttaaattaaaatgagtattgaattattatgtggaagtgagagaatatgatgtggagggataaaaatgaaaaagtagggtgttaaatttgtgaaccaatgtacatgagttgtttataataagaagtccatttcattactctcttgtcacttttattctttatttttattacttctaaaatattataatatataatattcaatagtgatgaactttttgggtccgaatagtaacatcatattttgttgtgtgagaaaagcggttttgtaatgcggtatggttcaactgcgatacatgcgggaaaaacgtatttgcgagacaagtgcggttagtacacaataatcggtataaaataaagtttgattggtgaaaatactatttgtactatacaataaaatgtttgaattatgaataatgtttcttagggtaataaagaaaattttcatatgtttataattcttaaatatctaaattgatataaaataacaatttctctagacataattattggtaaaaaaattaacattttcaaattcataaaaaaacacaacacaataaaaaactagtaataaattaagtgtttaacaaaaaaactaaatctaaaaagtgtatttcatatattaatattattacataaaaatgagaaatgagaaatgagaacacagagcgaatttgtcgaaaaacgcaacaagtaatttttttttccaaaatctgattttttaatgttaaatatatattatatgttatattacgagcaaaactaaagaaaataaatcatcctctccattttttcttggagaaaaaacccaaaaaaattttcatttattttttatttgcctgtttaatacctgcattatataatttgcccaaacaatatttaggttaattgtttttctctttaaaaaccttcatttttttaatttggcaaaatcagacatccgacttaacggatgttaaccttttaacggacgttctaactatagttaaaatttaactcatggtaattacaaatatatatacaatctattttctatattttgtaaatatgttaccttagtctagtggttaaacacagatttaatattctgatacaccagggtttgtaaccttcatacgacgtttaatatctctaagttctcatttctcattttgatataataatttttttttaacacttaattcaatatttttttttttggtcaaacaccatgttttcattcattcaaagaagaacaaatacacatagaaaggtttaaacaaaccaaagtttagaacaatagaacaacaagcattccccaatgccataaaaagaaaagagaggttcatcgattttgaaaccatgagagctatgcgacaagggcttggaggcacattgagacaagtgagatcacggtgaatcgagagctcatcctcgacagaatcggaggacgttaaagtagtcatagtcgatagacatttttgaagttgaagaaggaatcaatgctatgcttctcagtggagtgagatgagttacccaagacagtgcaataacaatgatttgggagactatggttctatagtcgaataaggatagctttgaaacccaaagcaaaaggttttgatctcttcggtaaatcccatcatgatctttgaaccctaggatctgaatgagggagatggtggtgaggttaagatacttgagaacgccagaagagctgcatgatgaagtgtcgacattgaccaaacgtagcccaataccacagttcatactccgacaaagccggtttgagataagtagatcaaagttcttcaagattttggaagcaaaccacaagaccctaagactagctaataccaggattcgtagagaatatatgcaatgccaattcaccagagatgttacctctctctcatggagtccacgaccatggagtaaaggaagacgactcaagcattgaattgggcttaacataatggttttaaaaactgacctggagatattagccttagaagttttggacaaggtaatgggcttgggctttctttgagagataaggcccaaaattgaaactaggtccaatggggaaaaccctagtttcattttggagagccaagacgggagaggggtgcggcggttgtccgatgctggcgaagagatatgcggtgaatagatcatctccgatgagagtagaaacagcggaaacaaacgatgaccgtagtccaaatataaggcaaagctccatagatgacaagcctttccggtgcgaaacttcatatacccaaatgaatggtcaccgtgcgccgtcgacgcctccttcaagcaaggtgcaactgacggttcaagctggtgtgaggattcttcaaggttgtaatgaatttccaaataattgaagtccaaactgatggatttaggaaataatcttcgattaaaatcggaggtttctgggcatatagatctgtcaaagaagctgagatgcagaggtaatagaagggctttgtcaaatccctcctctttccttcttcgattaatgggagagagcggcccagatccaaggtgggaagaaacagattgagtaaaagtgttcgagatgggttagattaaggaacaaaagaggggaaaaacttcaaaaggggaaaattaaaacagaaaactaaagatgagaagatttgtcgaagaaagaagaagagaataggatcccgacgccggtgagaacaagctacactggcgtcggaaaaaggttgaaggggagctgcctcgatagttgtaactgagagagaagacgatggctttgttgaggattgactctcttaattcaatatatatgtcaaataattttaatataattttaaaatatgaaatacacttgttagatttagtattttttttgttaaacacttaattcaataatattgtgttgtgcctatttatgaatttgaaatttttaaatttttttatcaattattatgtcaaaagcagattgcgacttttctctctgagagagacttttggagcgatcttcgaatctttctctatttcttccttttttctccaaatcggagtgtgtttccgacggaaaaccccgttattaggacagttgattcccacggtttctctctgtcacatttactcggtggcattttaccttttccatgtttttcgagggataaccgtatagagaaaccgccatggattgactcttatatatctgtcggaattttatccatttcctgttcttcaatctatccctacttctattccaaaaacccattgatctctgatatcacaacaatgagtgataacgttcgtaagtcactacaagatatcaatttagggattaatgatacgccagttgcattaccgccggaattgtgtggaagagcggccaccatcaactgtttctccttgattgtcacggtggttaaccctagaaagcagaacctcctggcggttgcgggatagatgcctaggatttggggatttgtaatgaatgtcgtggcaggataatgggcaacaacaaagttcttttcattttcaacacggaggaatcactgaaacttgttctccaacgtggaccttgggctttcaacgactggatgataacagtccactgggggtaccccattctatacgtgcgttcttttctacctcctacatgaaaccaaatattaaccacacaaatatttgtatgataccaaaaaccaataacgcaatgactctctcagattatagacccattgccttatgtagtgttctctataaaattatttccaaatgcttagttaatagactcaaacctcatttggattcgattatttcggattcctaagctgccttcatacttgggagactaatcacttgtaatataatgattgcacatgaagtaatgcactctttaaaaatacagaaaagagtatcccagaactatatggcaatcaaaacatatgttactaaggcatacaatagagtagaatggaattttttggaagtaacaaagaaactatttggttttttggaaaaatggatagagtagattatgggatctgtacgatcaatacgatactaaatacttgtaaatggtttacacgaaagtataattaaacaaggagacccactttcaccatatctttttatactctgtgcggatatcatgaatcatttgataagaacaaaagcttctactagaaaatttggggggtcagaataggcaatggagtcccagcgattactcacctacaatttgcggatgattcccttttcttttgtcaagctaataatcgcaattgtagtgcaataaaagaagcattcgaggtctatgaatattattcgggacataaaatcaatacaagcaaatctctcattacatttgggtccagaatcaatgggaatctccaaaaccgactaaaacaaatacttgaaataccgaaccatggaggtggtggaaagtacttggggttatcaaaaacaatttgggaaaaaaaaagaaatgttcacctacattatagatagagtaaaacagagaacacaaacttggaatgcaaaatatttatcaactgcaggaaaagaggttttgttaaatcagtagctctatctatgcctgtttattcaatgtcttgttgtaagctcccaattggcatagtttctgaaattgaatcactactcatgagattttggtgggagaaaggcaatcaaaatagaggcatcccatggattgcgtggaaacgacttaagtactaaaaaaatgaaggaggactcgggttcaaagaccttgctaaatttaatgatgctttacttgctaaacaagcttgcaggctcattaaacatccaactttattgtttgcaagaattatgaaatctcggtactataattattgtcagctactgaacgcaaaaaaaaaaagagataaacaatcctatggttgggcatctatattagcagaaccacaacaacaacttctactttaaagatttaatttccagccacggtacatacaggttttgaaatcataatttgatcccaaaccttgtccatcctgacgatcggaattcagtaaaacaaatgcatatccttaaaaccataataccagaccaacttgtttcgcattaccataaaacgggagaatataccgttcgttcaggatattggctaacctatcatcaatacatcgcacaacgcctattagctcactaaacaattgtatcttgactttttaaattcattaatataatcctattttcgacaaaaaaagatagaaattgttaatttatatcaatttgtatatttaaaatttataaatatacgaaaattttctttattacccaaaaaatcattattcatataattcaaacattttattgtataccgtaaatagtattttcaccaatcaaattttattttctaccgcttattgtgtactaaccgcacttgtcccgcaaatacatttttctcgcacgtagcgcagttgaaccgtaccgaattacaaaaccgcttttcccaaacaataaattacgctgttaccattcggacccaaagactgctttgttttgaaatggggtccacggtataatccgttggacaaaaccgtaaactatttttttagaaaaaaacacaaattggattaaacaaaaatagtaatcggtaacactactgcggtttgatagtaattttcgaaaacttctttttacaaattaccattcaccacctaaggcagtgaatggtgactttataatttgcggatttcgaaagaaaatgtgaaaaacgcactaatgtcataaattagacatatttgtgtaattttttttttacagataattccgcacacacgtttcaaagcatactatggataaagaaaactcactctactatcgttcaacagatattttgcaacggttcactaaaaaggaaaaatgtttatcagctacatgaagttaagccaacacatcgccatacatgcagactttaaaaatattttgttagctacacgaagtattgacatcacatacggacatacacgaacaaacagaagtcatgttgccaacaccataagcatcctactttgaccagaatccggcattgaccagtgatgaccggcattgactgatgtttaccggcgttgaccgatgttgaccaaaaaatatattcaatttgttttcttttaataaacaaataaaatcaataatttcttacatagtttttccaaaaactaataacaaaatataccacaaataatataacaaaataaaccacaaaacatcatttaacaaaattttggtttatacttttgatgatataactagattttaacctgcggaataccacgggtctaaattttattttagtatagcgactaattaatttcgtaagatataattcacagtgtaatacgtatttgttaattttaattttttctatgtttagatatattatttactatattttgcaaatataaatatgattgttttttatgtgtacaatataaatgtagaaaataagtaaatatacaccttattaagttgttttgatgtattttaattaattttaaacaattagtcttgtaattttggattagtcttgtaattttgcatccagataatttaaataaactgtaaatgctgttctttttagtttttcaggttgtattttgaaatctatatataaaaatctaggaatcaattcttcaagggagtctgaaatatttttaatattgcttcaaaacaataaacatattgtgggcttcatctttaacataaatataggcccacggatccacataaataactaaattgtttatgagaataaaaaccacagtatatctgaaaatagaattatctactttgttagcaacatttgttttgaatcggaatgaaatgtaaaaaaaaaacagccattactcatctcgactgattaattgttcttcttcttatgtaacagagatgtgtcgacaatatatgttcttcatcttttttgcaaaactgctcaaatcggcaaataattatttctactttccgtctagttgctcatcgttcctccaacaaacgacttctctatagtttctggagatctttgatgttctaacttcgttattttgatccgaattcttcccaattcaactccgatttgattatgcgaactgaaaggaagaaatggagacaaacaatcaactcagctcatcagaataaaaggcgtatgaagtttgtaaaggtgtgtatttttctagattattgaaatgaatttgcagatttgttttaatcagattttggaaaagattttttgaatttaacaatacttgattataatgtctctatgatggaacagtttagaacaattttaccactcggtttctcaaaaacatatctaccaaacattttgttatttcgtgttctcaggtcaaatagctgattaaactctagagttagatgtagccatatattgcagaggtgagaatctaatcttcttgtgttgcagtacagtttaaccactcggtttcttagaaacatagctaccaatttttaactgcaaacactttgttctttctgttttcagttctaatgtctgaataaactactgagcaagaggtggccatatattgcagaggtgagaatctaatcttcatgtgttgcagtattaggtgtttaaagttcaagtgtttgcaaaattcgttggatatgatatcttaggcaattataggtttgagtaagtctataactgattggaatcgtagactacctttttaaattgatgcaacttgttaaaatcgagtgtttattgaatcacaagatagatccaacttgagaaaatggaaaacacttgccacaatgcagcatgaaaccatgtgagcataatagtacttgtttgaactacgagtaacaactttagaattgtttttggatgctttcttagcttatttggtggactatgactttgcttgtttgaaactgagtttcctgcatatgtaaaaacatatgtgtttcattagacagtttgtttgcgggttattcaaaccataattgaattcaaatattatgaaggtatagtaaatataccttctcgactatagagatcacagaatatgtgagtagactattgtcactacatattatggaaaacctccttgaaaacgatattggtagtttgcttttgtatcttcccctctttgtcgagaattagtattttcaaacatgtcttagaagtaaccctagacagcgccacataaaattgaccatgagagaaaacaggtttaggcaagtacaatcctactttctcaagagattgtccctgactcttttttatggtcatagcaaatataacagagagaggaaacagtcttctacgcatcttgaatgtgagttttgtatctgaaggtgtgatgtttattagaggaatataaacgatatcattaatcctatctcttgttataactctagcttccacaatatgactacacaactgagttatctgtagcattgttccattacaaagaccacctttaggatctaaattcctaagtaacataacaggagccccaatcttcaaacgcaaagaatggtctgacatacctgatactataatattgtttaagaaatttggagtgataacatgattgtttagtgaatctgaatctgaaggatctatactatcagctgaaagatagattctttcttcacctgtgacaaataaaataacaatcaaatcttcataaaattaagaagaatacagaacataatttacaagattaaataatatagagttaatctaaacttactatccagatgctctagcatgtactgattgattgtgttaacatcatcgttttttggagctagaatagctctcttctaaagaattttggatcattgatttcgtgcagtttagttgcatctccatatatttctctactaatagcttctataggaatatctgcttcttgaatcaacaactcttcaggtatatctattagcgcctcaccatcattaggctcattgacccttccatcaccaacaaccaataaccaatcgaaaaattcttggatttctttagcttcatcaacacttaaatcattgtttaaaagccgcatattcttagtcaacttcaacactttgcagtgatcccaaatatatacagcatttagagatgacataacagtttctgctctccctgcaccatttattactggtagcacttgtctaaaatctcctccaaaaaccatgacctttccacaaaataccttattgtctacacgcttgataatatccgaaaagcttttatctaatgcttcaaaacaaaacttgctcttcattggagctttatcccaaataatgagagatgcttttttaataagatcaactaatttatcccaaataatgagagatgcttctttaataagatcagctaaatctgattttggtttgatcttacaaactgaaaattcgtctggattcaaaggtattgaaaatctataatgtgctattctacccccttctaacaacaaagaagcgataccactggaggcgatattaagacaggtctgacctttagatcttcctacagcagctagtgttttccaaataaatgtttttcctattcctccagagccataaacaaaaaaaaaaactcctcccatgtcattgaatactgcattagtaatctgatcataaatacctctttgttcaggcgtaagcatttgtatccactctgaatgtttttaattcagtaagttttaaattaaaatgatcttattgcgttttaaattcagaattttcatgatctagttatgttaatgagaataattgttgagattttccgtaactgcaagtgtgagaagatctattgaaaatattgtaataggagtattagatattagatcgtttgatgatttgggagggaaaagaaaagtttgctacggatttaaaccttggttagtttacacagaagattttgagaatatattgatgtcattgagatatatattgtatcgagatattaggaatcaaaggttgttatttgcataattgtagagattgcaagaattttgaaagattatataagagaatatatttgcactcgagaatattaattatgtttacgaaatcttgtaggtaatattcattgaaacatattccttaaacttctgcaatccaagatcaggataacattattccttaaaattatgcaatctaggatccaaacagagttaaaccggttaaaacccacccatttgaattaattgttgaattattcctcaaatcttcaacattatcttcaaaaaagtgctgtaaaaatgtatatatagactagatatacaaaaaaacaaaatttaacaaggcagacaacaaattctttttttagtactatattttgttatcaaattttggtaatataacaatgtataccatttccttttgacaatcctttttcttaaaatgtcaatggaagtgaatatatgggggagtgaagatgagggagtggagatttgataaggctgagggagatttgatgagggagtggagatttggaaattttaatttttatattcataacatcagtattaaattttaatcaaatcatagaaaattttacaaatcttattatataaagtacggtttcaaaaattactaactcacgagatcatgatagatggaaagtttaacgataagatgtttacatgtgtcatcaaagatttaaaaaattttattctctaagaaaatagaaacctaaaaaaagtaaacaaatttacatacactaatttttatctctatatatatacataataatttttattaatcaaaaataaaattaaaaactttgattttacatgcgatattggtcaattaaattaatctagcatttattaatttaaacaaaaccattagtaatgataataactaattaagaacccactgaagtataaaataacaaaataatttatttaacattaatttagttcgataaaattgtattttcaattaatatagtattttatttgaatacccactgggaatttttgtatagttatatttattttttaatataagaattttaatgcatgtagtcattagagaaaccaccaaaaattaggaaaatagggtttagagggattgatattttattatttgtgaaaatgttaatataaaatttcaatgttttattcataaatttgaagtcatctaatatgagtttgacattaggtaaaactaatttatgagattataaaatatagcaaaactatatcttaaacaatttttcttttccaaaatattttgtggttttcttttttttggttcattatgttttgttatttattaattattttcatatgaagtaattatattgatttgatatgatatacatattattttgatataaaatttaacacttattcattaaaataatatgtgcataatcaaaatcgggaatattatgatgaaatagatagttaaattgatagcaaaatagaatgtgtaagattaaaattttgggttttagaaaattactaaacaaaatacagaaaaatatgtgttgactactatttaaaatttaattttcatcaataaaataccgttaaagtcattaagtgtacagcaaaatcaaaattgtaagattaaaatttgattttaagcaaatttactaaattaaatatttaaaaataggaagtatcatttactatttagaattcaaatatcatcagtaaaaatttataattggttttttaaacccgcctatttaggcgggcctaacctagtgaaaaataaatggttgtgatagtatttactaatcaaaatttatatacatttattaaaacgagaaaggaaacttttgaagatatacaaaattactatagtttttttaaattatagtttagtatatttatattagatggtaatatgattatatgaattttttttcaaaacttaatcaaatcaattaatttagtcaaatcaaaaattattgaaatcaattaatttccatctctattaaatttatattaaaactctgacaagacaagaactttatcgaattcgtgaaagacttcatgtagaccgaagatgttggtcgtattatagtggattcgttggagttatgtgatgtgatcatggaaagcacaaaggacatggaatttgatcaagagcttgtagccgcggaagagcttgaagcagaggagcagcttgaacctgaggagcattttgaaacagaaaatgaacttataacggagaaagagtatgggaaagatgttatcttaacctcattggttttgatacatgatcatcaaatgggcatatgtctcatttgtactatttttcccttgtcaagttttgtcccaatggtttttcttgacaaggtttttaatgaggcaaatgattcacattcaaatcacccatttgataatccaaacaatggtataacattcagaagttggcccaatgtaatatatatgaagtccaaccaattttatgaccatcacaagctcaagaagaccccaaaccaagtggataatttgctggtcaagagaagtgacgaaaatagcatatcaagagtcattttggagccaagaagtggaagggttatttttaaactttcaaactagtctgtattttccaaggtagtcttgtgagtgtgttccaagacttctttctttataaactccttgtaatctcttatgagaactcatctatctttttatcaaaaactctctcttaaaaatagatcatggatccattttcgtatgtcgaattttgatctttctcgacttatcaaaaggattttccgcatccttttgtggcgtcattcaatccatcatctcgtctttgagtcgtgtgtcgtctctatttcgagaatatccactccagatcttccaagtgccgaaattgggattgattcctcaccaggatcatatcatgttgtatcagagcacacttggaggttgagtcgtttctgtctgtcatcttgttttaattttcataattatttggcgtgtgctaaaattgtgaaatcaattgtcacgggttcgaaaacgagtctagtatttttttaaattgtttttagaattgtttgaaacgatttgataatttttagtgtccgatcaagtcaaactgtcgtgattagggttctaggagagttttgtgtaagttgaagggtcattttgtgtttgttgtgttgaatactttctattacgaaaagaacttgttactggtgtatttgtgctttgtttctcaggtcgcaatgtcaacaactgaggagagatcaagccacaaccgcaacaagcatctaattgaagctcttaccactgaaatggggcaaattttcgacatccacttaaatcaaattcatcaagggcatcacaaagcacgaaaaaagaaggaacaagagcttaagtctaagccaccggataactcattgagatcaatacaaagcagcccacagaaaatcacccacactcccaaatccaaatctgtgtttcattttgattataaaccgactaatgcacttttgaaattttcaggaaaacaagattacctagagtgggagaaaaacatggacgagtggttttcctacaaaaacttcttgagcgaaatgagatttgtttgtgcacttagccacctcacgggagacgcttacaaatggtggttgcaagaagttgatgatcgcttatattataaggagccacctatcacattgtggagagattttaagaaactgctaagaaataagtatgctccacaagcactagaatgcactccaaaaggcaatcccaaaatccaagggttagcagctcaagaaaaggaacaaggcttagccccatattcgaagaaaaaccccatagcagaacaacagttgaaggatgaaattctgaagattctcaatgcttacaacaaacccaagaaagttaagtcaacatctcaaccaaagatggtcaccgaagaagttgtagttcacaagcaaaaccgacaaccatcacttgcatcaagcggtgaacaaaagcaatgtaagtcttctaatctttcaaaatccaggggagtcacttgttataactgtcgtaagaaaggacatttagttgcaacttgccctgaaaaatttgagctaactaatacttcattagaatcgaaactgagctcaccaaactcaagtagtgaagtagttagtcaaggattagaaaattctagttcttgtgtcacgcacttgttcttgtcaaaggatgttgattcaggtcatactatggagcatgagaatgacaaaactgaaggaagcacaaaagaggagaatcatcatttggtgtcaaccacttcacaagcttgtcgagctgactatgtttcaaaaatcaccatcttgaacatgaaaggaccgccatatgtatcccaaccaattctaaaccgagagttacgtaaacaagaaccacgtgaattaggaggattcactcaagttgaggctgtcatggtccacaaacaatcacctagagctgaatgcaatatttttttcaaggataaaccaccagatgctacaccaccatttaaaactcgaggtatttatctaaactcccaaaatcgaatgaaagctaatttgcgttctcttggtgaaggttgtacactttggggggcaatcaagaagactaatgatcgggagataagcactcatcatatgagtcaatcaagagatcctcgtgaagattatcaaaatcaacttcggctaaaaaacatggaagaatgcatagaggagcctgaaatggatatttcttcatttagtactttccatacctatcagtggcgaccaggagagttgttagatagctctagggaggaggaattggtcaccaacaatgccttgatccaaaaagaacccccggatccaacgccacttccattagtcatgatgataccaagcaccgaacacactgtgaaccttactcaggtaagtaactctttaactcgatttgtttctcatgtttctataattgttactatgagtttatcatatttaggaaacattgagaaagagttggatttatttaaagaatatttggaatcaaactcttgtcttaggataaaagtaaaacatgaacatttcaagaatggtgcattgattaaagttgagccatgtttacttgtttataatgatttcatgactatgataatgcacttgctttttgccaaaggtgttgacaacattgcaggtataaaagaggagccaccagacttagaatttctcatgtccaatctctttaagaggactggaattggagttgttttgaagccaaaggtcgattatccatccaaccgaacaagaagaaaaaacgacaatgcttatgaacttgagttgcaaggtaagtataatgtgagttccaatttcaatgattcttacttggtagttttcattgtaggtgaattggatttgaggtcaaatccttttcaagtgggagaggatgatgtgatcatggaaagcacaaaggacatggaatttgatcaagagcttgtagccgcggaagagcttgaagcagaggagcagcttgaacctgaggagcattttaaaacagaaaatgaacttataacggagaaagagtatgggaaagatgttatcttaacctcattgattttgatacatgatcatcaaatgggcatgtgtctcatttgtagtctttttcccttgtcaagttttgtcccaatgggttttcttgacaaggtttttaatgaggcaaatgattcacattcaaatcacccatttgatgatccaaaccatggtataacattcagaagttggcccaatggaatatatatgaagtccaaccaattttatgaccatcacaagcccaagaaaagcccaaaccaagtgggtaatttgctggtcaagagaagtgacgaaaatagcatatcaagagtcattttggagccaagaagtggaagggttatttttaaactttcaaactagtctttatttctttttattttccaaggtagtcttgtgagtgtgttctaagacttccttcttctttataaacttcttgtaatctcttatgagaactcatctatctttttatcaaaaactctctcttaaaaatagatcatggatccattttcgtatgtcgaattttgatctttctcgacttctcaaaaggtttttccgcatccttttgtgccgtcattcaatccatcatctcatctttgagtcgtgtgtcatctatatttcgagaatatccactccagatcttccaagtgccgaaattggaattgattcctcaccaggatcatatcattatggatgggactcatgtatgcgtaaaaataaagcttgagttacatggaatgtattggaatcgacgcgataatgcatcattgaacatcatggcaatatgtgatttgaatatgttatttacatatatttgaaatggagcaccaggttcatgtcacgatacaattgttctgcaaatagcaaaacaaagtgattccgagttcccttggcttctatcagagaagtattatctggttgattttggctacccaaacaaaaaataatttctagctccttatagatcgtcacgaaatcgagttgtgaaatatcatatgtctcaattctattctattccttttcttagaaacaaacatgaaatgtttaaccaatgtcacacatctttacagtttatctagagaacttttggagtttgaaaaaacaaattgaggattccttctgattttccaagatataatgttcacgttcaaaaaagagtggtaatggttacagtgggattatataattttatcagaatttcaaacctctcaaatgcagattttgcagatgtaatgacagaggcaaatataaataacaaagattttgatcatatatgttacaaatatgttatggaaaacatatatcccaaataagatgacatagaaccaacagagataacaaatggagaacatatatcccaaataagagacaatattacaaatatgttatggaaaaatcaaagtagtagataatatttttaatgttttttatgatgaaattagtcaacgcatgtaataatatatagggaatgtgacacgtttaggcacttttagagaatctttttccttttgaggcacttttcagggatgaggcactttgccatctttttagggaaaattagagtaatttacccctgaaatagtgatgacgcaataatttttaaactcattttttatgagattgtgtgggtaagaaactatcctctttttatcatctctctcttccatattcttttgttttcaccatttttaatctctctttcaaaatcattgtcgttctataattcttacaaaatcatgaaaattatgaggttatctcaaaattcacaatcacaatctatgtttatcctaaatttcctttattttgtcagttttgtatctttttctctattcgagggatgctggaattgggaaagaagaaaaattgaatcgttgtttgggagaggtaagagcatctttaaccaaattctattctctctggtattggatttttacttggttttatctgtttcttaagattgaatattaaattgataaatattaagataagattctatcccaagttaggattgatttgagaaattacttgaagaatattaaattaagtagttcactcaatcccaagttaggatcgagtgatatgaatgttgtgaattgacattgaaatttgatttgttgagatgcatctggttttccagttaaaattctaataccctttttgctctatttccagcccatagatacgtagttgatcttcaagaactttggctaccaataactttgtgtttaatccctttctagctcaaaactgttagggaagatgtgatatttggtcttattggagctatcgtttcccaacatatacatctttcggatctagaaatgatgtgtttagatcacacacctatacacacctctgtatccatatgatttttgtccattttgtggctgtccgcataatacgtcaaatcagacatgactttatggccaactattctttggtattactaagcagataagcagtgtaatacacaagatttctaaatgataatctgatttcttagtttgactgttaaacgtttatctcggttttgatacatgagcctttgaatattcttgcaactagcactccaatttgatggtgtagaagaaaagaatgtgaagaagcgagcatgagagcttgaagtttcctacggaggaagcggaggtggtggttggtaaagatagtttgattaacgtttttgatgaaacagatcgtttgaagtctttttctctcttctttgacacttttttttctctctcttggtcattagttcacatcgaacaaaaatatagttgtccattagttactgttcaagtggtgtagttgatatggttatcatgtgattcatgccatgttttttacattagctacaatcaccaatttcccagacatcatccattttgttttgacaatttgttcacatgtatatggatactcttatcattgcatagcatttggccactctgttgaatttgatgacgttaaactgatcatttggataatttgaaagtgtttagatcccttaatccattgtggtgatgatgttgtctcaagcctgcaacaagtcttgatgattcaaattaacgtaaaacgaagtgaacctctaatccttatccactaaatttgaaacattgttaacaaattaaaacctgaattcagctaaggagaatcgatatttgggtcttaaaaaaaggaaagccacatgattgttgagattaatcctttgaaagttcaagtctatgggtcaaactcgtttcatctacatagcatcgagattcctgttaatcgaatctcctgttattgacatggtatataggatggatatagatctgtaaaaaggttttcgaatgaatatatttaaatggactcgttattatggacaccaaaaaattgtttgttgatttttctttcagtttgcagacctccacctccaatactttatggacatgaaactttggtttctttaaaaaccacggttaatcgaatctcctgttattatggacatggtatatagaaatatggatcagtaaaaaggtttccgaatagatatatttaaatggactcgttattatggacaccaaaaaattgtttggtgatttttttttcagtttgcagagacttccacctccaagaccttatggacatgaactttggtttctttacaaaccatggttaatcgaatctcctgttattttgaacatggtatatagaatggatatggatgagtaaaaaggtttttgaatggatatatttaaacagactttttattatggataccaaaaattgtttgttgatttttcatacagtttgcagagacctccactaaaacccaaattccataattacttttcgtcgattaaagcaaattttagaaactgacgaaatcctatccaatttcgggtttagagaatactttcaccgaatcaaaaccatacaaaaaggaattcagtaaatagaacactaaaccagttttatgaaatcaaatcaccaaaccaaacaccttcgtgaaatcaaaagaaatcatgtgagagagagaggactaacttggaggagggcgtggaggattcttctcgagccagtggcggatgtgcttggcgttacgtcttaaaacagtgacaaattgcttcacatcgtttttgtacatggccatagtcgaaacttgactgataaagctataccagagagtaaggattcaaattagttttgcagcaaccagagagagagcaaaatttgaatttcaaattctaacaaaatcctagagattagagtataacaaaattgaggaacgaattggtaaattgaatgaattggtaaaggtttttattttataaaataaaattacaacatgttatcaacacgatcactctgccatgttaatctatattattatcatagcgcggctctgccgcccctttataaatataatgcttttatatggttgtttaacgcaccatcttatttattgttttaaaattcttaatatggataatttgatcaccataatttacttcttgtttctatggatgatttttatcaacatattccatttaatactctaatttacagttttaagtttttttaacatggatgattttaataactatatttgatttaatattttaatttgctgctttaacatggatgattttaattattatattctatttaatattttaatttattgctttaacttggatgatctacattaccatatgttttattggctgcttttaatttattctttcatatcaatgatttagtcatcatattattatcatagtatcattattataaaaataatataatcttatgtataaattaatatatattttcttgattatttatttttagactaaattttatttttaaatctcaatggtcataaattaataaatgaaattaattacccaagctttaaaatattttttaattttcaaacggctacttaatagctaatgaacagtttattttatctatatactagaataaaatctgggctacactcggtatatctctaacaattaatattttaaagttttttatatttaattttatatttaaggctttagtacttccacccaaatgtctataaggtattgttaattatattattttatctatctataattattttgtcattgtaattttttgtggaagtagtgattcatttttacttcttttaattgtgtatatatagtatttttcacatcttgtaatgtatttttccattgtctctaccccaacttctgaagtcctgtctaaattatttttgtaacattatatttaatttttattttaagatagattttagttttattgtgcatgtctaagataagatgactaacaaataatttaattacaatttcatatttagtttcttatgttaagaatatttaagtaattttctgtcttcttagaccatacgactatcatattagttcatatagtaatagtaatattaagcatagttgttaattttttggaatattttaaaagactattgagtatgattatccatgtgaaagaatcatatataacctcatactaccaagtcttatctatggttgtttacttatatgcgattgtgctatatacgaattagaaggtgatatattcttgctgaaaattacatctgttaagattaattatcatttgaaagttaactttagattgcaaattatcactgagacgataagtgtgtagttttttttgttagacgtctcccttctcttgacaacgtttttgttccctttgctggccttaactctttgtcacccctcaccagtaaattaaaatccatatacatgtgttccttgattaccatatttacttctaagagaagaagttaaacatgtacctaagtgaatattttgagagctggatcatttgcaactcccggcggcatgcatatccgatcctaacattgcaggtatcatgattaccacaaatcttaatttatcaaagacaaatgtatttatgagctcagtcatggtaaatcagtggagttcaagtgctcacagtctaacaattatcacttaaaataacaccatgagtaaaattctagtttaaccaaaaatttagaaatgtaatgtgtagtatcctagttttaacttcttgctttgttctttttctttttctttcttgtatacaactgttagagccattaaaaattaataaagatttaaaatcattcattgtgttttgcaatgatgatgtcacaagattttgtggagatatataattctttactacatgaagatacttgaagagttgaagatagtaagatgaatttattaaatttgattttcgaatttatgtattcaaaaaatgaaaatattactatattgatggaaagtgagaaacataaagttgaaaatacttagatgacgaataatatgatctgaagattggcttccatcacagcctaacatgaggttaatgttactgttccgttttttgtagcaggtcattgagttcttggtatccctttatgccatgtccgaggttgaatagtatgtttgtctaaccagtgctacctgttgagaaaatgactaacaaattgctgttttgttaaagaaaaatgactaaccagttgtttcatttccagtgacctaggattgttgtgttgaatgttgatactcgtatgaggttaaccactaaagaaagtcaacaaacctttctcttggagttataccacgaagataattattataaacgtcatttaatactttcttctatccatattgggtctctgttgtgtagggttcgtcatgtcaatgatgtaagtgaacatctttttgctgaagatgtgaagtaaaaaatatatgaacaaagtttctacatgaagaagggtcaagaaatcaagatgaagtaagaaatctgaaatatctattcggatccttattcataacacaaatatacagagaaataacattctctttaattatgaggatatcaaatagtgaagcatcattgaaacacaaaagtgatataaacctatcaaatcccacattgttatattaaacttacataagctactaacagaagagtgcataaacaatacctgtctacactaatatttgaaaagccgacaaagaaaagtgacaacttaaggagcgtaccaagttggctctatgacaacttcaaacaaaactgagggacctctgttcatacggacaatcggatctgaaatcaggaaacaaaaacaaaaaaggtgaaaagaaagccttcaatgatgtagatatgagtatatgcatcggttattagaactgaataagttatgggaaaggaaactgttcaacttactgacattatcatctatgtaaaccctattaaagtctaaaattttgaagcaatttcttaaatttaaaagaaaaattgtgtcatataagttttttgattgatggtgatgatacaccaactggaagaaaattagaaacgcatagtttttaggctaatgtggcatcctcttagatagtttttattttgctgatgtggtcactttgagaggcatcaaagagcttcttttattagtagtagatactcttatttctcattcattcatctcactcaattatttcattttctccgaatatcatctctctaaaaatgactcatccgtttttagtttttgtaatcgtttttataattgttgcaatttatggtaattgtatttcttgtacttgcattgcttattcaagcacctctcatgttctaaaatgaaataaattaaatttctaataaaattctttaaaaatttattttagaaacgaaatggcaaatatcgagaagctccaattttctgcctttaaagattaccggggctaactacatatcgtggattaccaatgttgagctacatttaacggagactataaagagaataattcttcaacggcccaaaaaaaaaacaaaatcggtgatcttccttagaagacacctggatgaaagtgtcatatatgactatgcacacatgagagatcttaaagaactaaggaattctttgaaagattgttttaatcaccaaagggacatcactctcccacttgcccggaacgaatggcaaagtctaaggttccaagactttgacaaggtaatgaaatacaattccgccatgttaagaattgtggccaaactgagatattgtggtcaaaaactatttctgaatcccatatccttgaaaaaacgtacaccatgtttcacaaaaaccacattactttgtaacaacaataaaggttgcgtggatataccaaattctcagatttgattgtggcgctcttaatagctgaaaagaaagtgagctcctaatcaagaatcacatgtcccgacctaccggatcaaaggaattccctgaggtgaaatgcattggatgttaaaaatccggaaagagaaaacaaaacttttaggggacgtggttgccgaagctaacgcggaagtggaagaggctttaatccacaaaccatgaattaatagcaatggattcgtcctgagcatgattcgaaaggaaagaaatccaagcaaatacttctcaagaaaacgtgagagtgcttgtttcagatgtgtcactaagggacattggtctcaagtatgccaaaatccagcatacctttgtgctctatacaaataatccgctaagggaaaaggaaagaaaatgaaccttgaagaacattctaagggtacaacccaccttgatgcttctgactttgctaatgatctcgatgaggctgcccttcttgaaaactgaaatttctatcgtgcatgcctcgaatttatgtgccataaataaatcgacgcttgcttgaaatgtcctaaatttgtgtgcttgtattacctatcatgtataagtatcatgtgcttgtgttacctatcatgtataataatcatgtgctttgtgtttgatgaataaatttattttctacttacattaatggattatgtttattttagaaatggatcacattacaacttgaacattatctaaggcaaaccttggagatatttgcataccggatagtggaacaacgcacactattctaaaacataaaaaataaatctctaatttgaaatcgacgaaagttatcgttaacacaatatcaggtcccatagacttaattaaagggaccggtaaagcaatttttgcattacctaacgggacaaagttctcgataaacaatgcattgttttttccaaattcaaacagaaattttttgagtttcaaagatatatacctttatggatttgacactcagtttgcagctgagaatggatggaaaaaagtacatgtatatcacttctgaaaatttaggaaaaagacacattttggaaaaattaccaagactcccatcaggattgcatcatacatccattaattcaatagaatcacatcatgttatcaaaagagatcatgatgatcacattgtggcacgatcgtcttggtcatccaggcaccacgatgatgcaaaaaattatagagagctcacatggacattcaatgaaaccccaagcgatttatcaagggacatgtgttgcgtgttccctaggaagattgattataaggccatcgccaagcaaaatcgataaagaattaccaaaattccttgaacgagtctaaggtgacatttgtaaacctatacacccaccatgtggaccattctattatttcatggtaatgatagatgcgtctagtagatagtcacatgtttgtttgttatcatctcaaaatgtggcatttgcaagatttttgactcaaataatcaaactaagagctcagtttcatgattgtcaaatcaatggacttagattagataacggtgatgaatttacgtctcaagcattcaatgatttttgcatggtaacaagaataaatgtcgaacaccatgtagcccatgtcaatacacaaaatggcttggctgaatctttaattaaacgtttgcaattaattgtgaggccgttaatcatgagatcgaatcttccaacctcagtctagagacattctattttgcatgcaaaatcacttatacgcataagaccaagtgcatatcacaatcattctccattacaattagcatttggtcgagaacttaatatttctcatctaaaaatctttggttgtgcggtatatgttctcattgcacctccataacgtactaaaatggggccacggagaaggttaggaatatatgttggttgtgatactccgtaaattatatgatacctataacatcaaactggtgacgtatttaccgcatgttttgccgattgtcactttgacaaaaaagaattcccagttctagggagagaaaataaaaagatggaaaaggaaattaaatggtgtgtaccatcactattacaccttgatcctcccactaaacagtcagaactggaagtttgacgaattgtgcatttatagagtttagcaaaccaactacctaatgcatttgtggataccaaaacggtaactaaatcacatataccagcagtaaatgctcgtgatcggcttgaaatcccacaagaacaagggaaagtagatgaaacgcgtgagcctaaaacacgattgaaacgcggtagaccaattggttctaaggccaaaaatcccacaaagcgaaaagaaacggaaaaacatgatactctcataataacagaaaatgttatgggagaaacaaatcatgaccctatcaataatgatgaacctcatgaatcggaagaaaatcatgagatgtctatcaattacgtccatatataatgaaaagatatggaatcaaaataaaatggatgatattttcttgttccttgtttcaagagaaataaatgaagaaaacaaagatctagaaccaaagtctgtgtatgaatgtcaaaagaggcatggctggataaaatgaaaagatgcaatacaagttgaacttgatttgcttaaccaaaaaaatgtatttggacctataatggtcacacatgagactgtaaaaccggacagttataaataggtttttgtccgaaaacgtaatgaacaaaatgaaataacgagctacaaagctcgtcttgtggcccaaggtttctctcagagaattgattacgaggaaacatattctcctgttatggatgccatcatatttaggtttttaatgagctttacagctaataaaattctagaaatgcgactcatggacgtcgtaacaacatatttatatggatcattagatgctgacatgtacatgagaattccaaatggatttaaaatgactaaaaagttaaactctaaacccatagagttatgtgcaataaaattacaaagatcattgtatggtttataacagtctggacgtatgtggtataatcgtcgaagtgagcatttaataaaagaaagatatgtaaataaccctatatttccatgtgttatcatcaagcaactatatctagattcgtaattattgcagtatatgttggtgatataaacatcatcggaactcaagagttttgccttggtttataaattggacattctcataaggattttttgtacatcaatctacagctaaaagagttttaaaacgttttaaaatggataaagcaaatcctcttagtacaccaatggtcgttagttcacttaatgttaaaactgatcctttccgaccacatgaagaaaatgaagagatacttgatcctaaagtacccccgtatctaagcgcaatcggaggctttacgtaccttgcaaattgcactagacctgatatatcatttgctattaatattttagcaatatttagtttgttccttacacaaagacactggaatgggataaaacatgtttttcgtaaccttcaagggactattgatttagggttattttaccctaaaaactcaaaaggtcaaattttggttttgtagatgcgagatatttatcaaatccacataaagctcgatcccaaactggatatattttcacgaaattgggggcacttctatatcgtgacgttctcagaaacagacactagtagccacctcttcaaaccacattgaaatcatcgcacttcacgaagcgagtggaactttttgtggctaagataaataagtcagcacattcaatcaagcagtggaatgcatgtgaatatagaaccaaccgtcttatatgaggataatgatgcatgtgttgcttagacaaaagaaggatatattaaaaacgctagaacctaacatatccctccaaaattattttcatatacccaagagcttgagaagaataaagaaatttaagtgaaatatgttcgatcatgtaacaatgctgcagatctcttcataaagtcattacatactacaactttcagaaaacatgtccataacattggaatacgccatcaacagaatctttagagtatcgttcctagtcattcgagggggagcttgtatcattgtactcttttaccttactatggttttatactaatgggatttcctagaattgtttttaacaaggcaacatgaaggacatcgcaaagagataaatgacaaataaactccaagggagagtgttgcaaaagtcaaagaaacacttgcgtatcaaatattatatagagcccaaattcatttatcacttaccgtaatatttgtctattctcttcgattaagtagtaaaaacactcatctaaatacaaaaaaaaaattaatataaaggttttctattattacttttttcatgattgttctctttctcatatttttttttcttatagtatatctatcattattctttttttttctaatgtcttcatcaataaaaaagagtaataaaaacaagagttgaaaaacaaagtacatcaactaagaaacagaacgaaagatataaaaagaataaaccttattcgtgagaccttaacggtgcgaaaggctctctgctgctattgagttgagagcgatattttggccacttctctggtgacgctagcgcctgtaaagccgatgcacaatctgaccaaacttcacacgattcaatatgaagatcatgtaagctttgaagactccattggatgcatcttaactccgcttcaattctattgatcattggtagaaaagaatcacgagcgtgaaacagaacatcacctaaatgatttcgcaaaatccaggctcccccacaagagttgaatcgctaatctatgaagaatggacattacatttaagacaacccaattctaacttactccaacgacgggacaacctgctaatccttttacctagcgaacaattttcttgagaagccacagagttttgtgtactccattcctctgcttcttccaatgtagtggctatcacgatattgtggtcgttgactctatctgcatagactgaagaatttcgtgctttcaaaagcccccatacaatccatggaattgaattttgtaactccactggtaattctactctcttcatgaagttcataacatgctctatattctcaaattgagtacgttcttcatgtgacttcacaacagcaaacaccggaagcaatagccaatagccttcataacttcttgtggcttgtgaggcatcaaatgaacaaaataagagctataagcatatgaaactttagagttaaaaaatgtaagaaaacaagaaatgttttaaaaatttaccttgtaccaaactagcaaagtgatttagacatccaatggtggtggattgtctaactcagagaaagcttacaaacaagaatttttttttgttaagtttaagcatcaatagaagagaggaaataacatgtaattagcaaagatacaaacttttttgaagtttgtcttcatacttgacatcagcaagtatttgtaaatttgtaaggacttttgcttcatctttcaggtcttgtttcatccactgctcaatacacatcaaaatttcaaccatatagtgtgttagacaacttccactagtgctaaaagcactttcagatgcaacactggaaacttgcgtagcaaatacatctctagccatctatgacaatattgggtacttgccacaattgtccttccaccatgagagaggagtccacttagttcctggaaacaccactggattctcaacatgttccttcagatatgaatacaactcattctttgtttgtttcactcatgtcacattcagtaaagcattgtaccttttatcaatagaacgataactaggatcttcttcaacacccaattctgtctctgcttgcttttcttgagtagactgagatgactgtgattgagaatcttgcacatcggtagctttaccataccttccagtatactccttaaacatatccaccaagatatcatagacagattcataaagcaccttagcatttgtagaaccttcactatacaaatccgcaaaacacaagtttgcaaattgcatcttcttcctaggatcaaacacagtcgccactatccacatctttatgttcttcaagccatcccaatacttatcaaatttttcatacatatccttagcctttttcttcaaatcactgtcaaaactattacgatgtatccgaagattcgttgttatgttcactatctcaccaaaacacttgtgagaattcaaagtagtagaggttgagactaccaaggtagagtggtagaaaatgaccaaaaacttattgatcctctctactgcacgtcaatcttccagtgaaggaggtccaatcctttttttccccttttcagactccaagaaatggtcattgtacagcttggcctctaactccatcttttcaaacgcagctttgaaaaaaactgcctttgacaacatcaaaaaatgtagagttccatcttgtcttgatatctaatggtaaactacctctagtcatcctaccagaatttaccttctgttcaaatgctttttgcctatttgttcccgatctaacataagagacagcatttcggattgcatttatactattatctagatcagccaatccatcccccataatcaaagtaatgatatgatcagcacatctcatatggaagaattcccctttcatcacaaaagcatcattcgaaagactggaaaagctagatttaaacctcattaacgcattactattagcagtagcattgtcaacagtcacacaaaagatcttttctatcccccaatcagctaggcattctagtaaaacaacagcaattgtctcacctttgtgatctgtgacatacttgaaacctataatcagcttctctaacttccaataggcatcaacataatgtgttgttataaccatataactatcacctgtgaatagcaatcaacattaagtcatgttaatacattaagtaagacaagttaatgatcgcaaattaattttagaaattcagaaaacattacctatgacatgagaaacccatatatcttatgtaagcgagactctttgattgttgccttggaaccatttccttagagcagcctttctcttaacatacatctcaacaatgtttcttgttgcggttcttcttgagtgtggattgcacaagattacctaaatagtatatacaatgagagagagagtcattcaactattcaagtatagaaatatgtaaaaagaaagaatctaccttatttcaaaagtaccttgttgcaaaagtgtctccaagccatactttcaatgaaagaatatggcaactctcctatcacaagcatctcattcactgcttctctgaaaaacattctcagaaacttttgtaacttgaagatttcctttcttgttaataacttgttgaccctctttcggatcttgaccatctttccatgctttgtattccttacaaatctcaagatgattccacaagtttttagtccctgaatttgttggatatgaaagctcctttttgcaatagtgacaattactctcgtcacggatgggcaatcgtcttttgaaatgattctacacatctgatcttgagggaagtatcttcttaggcttagtttgttcagacgaatctccagcttcaggtgtttgcttccttttacccctttgacccaaatcaggagtcatatactcttcttcatcatcaaaatctctgttatcttcagctggtaatgatgatgatgaatccatctacaaataagaagaatataataaattgattattatctttgttttctctcggataacattacaaagactaatgatcagagattcaaagtatcaaaaatacgaagaaacattacaaataaattaagaatactgatcagacacatatagaaacataaacaagttactaaagcgttaaaaaaaaatccagaacctatttccaaataaaaaaagcacgacatctagaaacaaactccacatgaaggcataaacttgaatctagttacaaaatatctacttattctttcaaattatctacgttgaattattgccacaacaaactccactatgtgaaatacagtcaaatgataataagtcatctaacaagccatctattattagacaaagacaataacgacatctagcaacatacatataaaaatacagaacatcaatcaagtgattagacaaaaacaatcatgagacaaactatgtgtaacaaaggcaagcatataaacaattacagagactaaaaagaagtcattaacatagaaagacgaaatctaacaaaataacaaacatagaaacataaatttttaaatatcagacaaacatagcaacattaactagttacgaaagagtaaagaagaagccaccaactagtttcaagaaacacgacatctaccaagtagcatcaaactccacatgaagccatatactatgtcaaaataccattagccttatttcaaggtcaataaacattatacagaaaatcgacaactagcaacaaacattacaaaatacagaatatcatacaactaatgatcatacaaagataatgaaaaaattacgaagaagaggaagactttagtacctgtgaatgatacttcgagttctctgatggaggagacgctgcaaaattgctaataagggtttctagtttgcttagtgggggtatatatatatatataggatttgtgaatcatggctcgcaaatttcggagatcgccgctgagtagtggagaaatcgaagaaaggaaagtgaattagggttctaagtctcagaaatgcttatatatgttcgggttagttcggatggggttcgattatcgggtaataaccgattgggtacgggtaaccaaagacatgaaatctataaaccgatcgggttattaatagaatccatacccgtactgaaccccttaattcgggtcgggttcgggttcggggatcgggtatgggtaatgtgcccagtcctattctcaattatagatgtggagaaaccttattggaattatcctcataatatatttttggagtcccagtcaagaatgtcactgaaccagaaatttgaatccggcatgccactttttgatctgtatgccactttatatgtgttattcctattttacccttaatgaataattttttatttaatttcaaaaataaaataaaaataagaaaaacataaatattctatatataaaccctacaaaaacgttggatttaatttagtgactgtatttactcaacatatggaccccactaaaaaatattttatctttttgcggtagaagatactcgtagttataccgttgtaccatcgtattcatagttgaactttccacaattttcataatttacagttgaattagaaggtaaataattaattataagttgaacgcacactttttctctattattttgtatttccaaagttttcataatatgacatcggtgaaaacttggttttttacctattttacttcatataaggtgctcatagactaaatgtttcttatattagaaggggtgttttatatgaaaacaaaattggattttagaaaatattaaattttattgcattgatctaaaattatttatttataatttgggatattcgtatataattttacatgtataataaattatcaattttacaaatttaatcattttaacgttatttagttgaactagttgaactaattatattaaatgttaccacgaaaaccaaagaaagacatttgaactagctcaactaaataaattaaaaagtaccacgaacacaaatacatatatgtttttaatctaatccaataagttgaactagttgaattgttcatacaaatccgagaaatacaaattcaaaatacatgaattaattttttcatgtgcaacaaattgttcaagtgtatcccaggcatagtcttgttcttcctcttacgacgcttttctctggttgatggaaaccagtttttttttttttttaaccattttttggtgtataaattcaattggctctgtcgactcgggaaaaaccatctctggtcggctcatccatttcggcagccgtcgattctcaggtgatgtgtcttcctccatcgatattgttggatcgaaatctagatcgatatctcgatatttactttgtccactctggaaacgttcctcctttagagataccatctccggtcgactcatatatttcatcggtcgctttttcttccgtcgcaacgtcttcttttctttacaagcgctttgtttgttctactctgtctatagatctcgattgaagaaagtgaatgaacgaaacaaaaatggctgtttagatatttgcaatggtagtcagtacaatgtagtaactgaatcgcgttgctccccaaaccaatccattgttgcataataaaatggtataactgaaattggttcaattgatctagttcaaatggttcaactgatctagttcaaatagttcaactgatctagttcatctggttcaatcgaacgagttcaacttatatagttcaaattgttcaattgaataagttccaatcgatttttcgggcgtatgatatgagtaaatttggaaaatgccttttttatgagtttttatttgaaaaatactatatcctactttatatataaaattaataaaataacctcattataatttaatataattaaaactttaaacagaaaaaatccataagttaatatttgatttaactataatttaaaagataattcttatcttaaatattttaaacaaaattttgtccaaaataatatatataaactatatttatttcaaaactatatttatttcaaactatatgtattaagtgataaactttaaaataatatatataaactatatttattaagtgataaactttaaaatatatttagatattaaattgttaaattttaatataaatagataaataaactatatttatttcaaaaataattaaaaatgttatcaacaactaaaacatatttcgaataatacatacatttcgaatttatcaatagagatttttaaaaaaaaatctattacttatatttcaaaatttatttaattttaatttttttcttctaaatatgaatcctgtttttatttattaagaataatgcttttaaatttggataaaactgttactttacatattaaaaatatagtattatttgggccaagttaattattttattgtacttgggtcggattattttagttggatctgtatattttaattttttaaaaagttatttggatatttacatcagttttaattataaaaaaaaataaaattataaagaataagtggcattcgtgattattattttggagaaagtgacattcctgccatttattcaaatttttgtggcaagtgaagcgacaggtaaagtaaaaccgacgccgttttaaaagccagtgcctttacgctatccgttgaaaagggaatacaaagtctcgatttttttttccgatacttgaacggccagattttaaggttcctgtcatgtctgattgcgaaatcgcttttttcttcttcctgagttcctttttttctccgatgaaattttaaccgtgatgatgatgatcataatgaaacagatatgagcaagaaaaatctagcgattctgttgcgtgctagaatgagatccaacaatccctccaaattttccctctctcaatttcctgtaagcttttctttttctctgtttgaattttttggataattttgcgattctgtccaaattcacacaatttgtaatcatgggcaatgaaaagtttacatcttttgatgaaaaagagagagagagagtgagaaattggctatggctttaatcggagcttgaatgtttttaagaagataagaatataataaggctaatttgactctataataatggtttgttgactttgttgtcagaaggaaattcaatctaatcctcaagagaatcattctagagatcacattgtgcaaaattctaatgattttggtaccactggaaggtaatttctcattgtagatattgatttagcaccattgatctttgcagtagtgagtttggtttttgttttagggtttatgatgttgttcgagagacaatgcactcagctatctcagctagtaaaactggtgtattagacattactcttaatgattttcaagaggtaaaactatcttcacattgttgtttcttgattctgatctttgatgtgtttaaccttttcaatctgattacatatatggttaaaaatgcttatagggttactttagcctttcgcttgaagaccgcgagaagttactgcttgttttagccaaggagtatgatgttaaccgagagcaagtccgagaacttgttaagcaatatcttggacttgaaactccagctagtgagagtcattcttgtgccattcttgttttttcttgtgtgattcttcgttacattctccattgatgggcgagtacttttctttaggtgatgatgataagggggctttatcttctgttttctatcgcattgagaggaatctgaggcatgctcttaggccaacatatgaagttttatttgagaggttgaatacacatcctggagggttgagatttttgtccatcctccgagctgatcttctgtcgatactctcgtaatgtttcttgtcctcttgttatgtgactggaaactcaaatatttgaagatagtttcgaatcagttggtaaaacatttccggttgtatctgacactgatggttgtttctaatgtatagaaaagagaacacgccgtctttgcgaacattagattcttttctgaaggagaaactcggtatgtggcttagtcctgccactttagagcttcatcaaattacttgggatgatcctgcttcattgcttgagaaaattgttgcatatgaggtatgcagtactagtctccattatagtaatctcagctatttcagaatgttaaaagttttgtctaataacgcattatttataaggcggtgcatccaatcagcaacctcttggatcttaaaagaagattgggaataggccgtcgatgctttggatattttcatccatctgttcctggttagttactttctctggactcatgtctctttgattgtaagttgaccacattctttgatcattctatgtcgttactctcaggtgagccacttatttttatagaagttgctcttatggagactgttgctcagacaattcaggtcaaactaatcttgatactattcggtatagtttagattctatagctatgtgtctaaaaaattcattggcgttgcaggaagttttgtgggacaatcctcccataccagagaaccaagcaacatgcgctttattttactctatttcttcaactcaggtatgtgcacactcttccttcatatctgtagttcttacatttgttctcgttgattttcacattttctattcatttcgtggttctgatgaaagctatggctttatgacttctgtcttatgtatttgcagcctggcttagctgggataaacctcggaaaatttctgatcaaacgagtgattacgttggtgaaaaaagacatgccacatgtttctgtgagtactttgactaatttgtatgcaaatcttgttacaggtctaaaagtttgtatctgcttgctcaacaaaactgttctttttgttgcagacatttgcaacacttagccccattcctggattcatgcaatggctcctctcgaagttatcatctcagtcaagatttgctgaagatgagcgtggtacacagagcaattcgccttcatctacgtttagtgagaaagtattactaccagaagaggaacatgccctcatgactctatcagagtaagattttcttcatgcccttatgttcttatctgttatatagaaaatcaagttcaagtcatcaactcagtgatctttttatgcagtgaatcttcatccggtagcaacggtatggaagttctgttgaatttgctatcagtaaagaactgcgattgggctacttcgcctcgcctattaccagttttagaacctattcttatgcggttatgtgctaggtatgttcattcttggaggagatgtaatggttatatatgaatcatataggcataactttcaatggtctttcttgattttgataggtacctcttgcaagagaagaagagaggaaaagctttagactctgttgctaacttccacttgcaaaatggagcggtaagtccagtgaatgacgataggttttagttaatagagtgattgagattgataagctttcatgttttgatacgttacatagatggttgaaagaataaattggatggcggatcgatcagagaaaggtattcgtcaaagtggaggcattatggtaaactatgtctataggtaaagtaaactttgtactttaaattattcagctacgaagctttcatttttgttggtcctaaacccatcttattcgattcatgacaggttagagaatatcgaagactatgctcaatcgtattttgggtcgggcaaaatccatgcctctcccggtatccattcccgtctctaggtaactccgcaaagaaaatcgggttttgatcgatttgcaggtaaaaaaaactaaggtatcaaaacctgggagtaacatagcacaatggtatgtatatgtatgtacaaacggtttcaagtgtgtatactctcaagactctatatatatgaatgtgattcgaagagatattcggtttcacttatcagaatcggtttcgacatggctagtctccaagacgtactcgcgcatgagtcttgtgttggaatcatctacgttctgcattttcaaaaacacaagatgcttcattacgtacttgcattcatatatgtacaacgagagagagagatagatagaagtgaaccttgaaggcgaggcgcttcatattatcccattcgaaatcgtttttacaataagcagaccgtacctaagcggtaacaaacggtttcaaaccgtaaatacaaacgtagagatgagaaaagatgtagaagtgttttcgaaaatgtattaaaggagaaaagaaaagcttagcttacctctaaaattcgaagggcttgttgcattggccatgataccaaaaaaaaaaagcaaagtttttagtttacttatctcatatcaagtatatgtatacctaaaagatatacgaaacttatggatctacaaagtgatttcgttagtaatccgcaaattggtggaattgtatttcgtcacgcaatttttgaagtagtttttctttacaagaattgcacagattagttgtgttatactgttagttttgtgcctgagcaaattacccgaaccagatgtaccaaaccaaaaccgaagtaaacagaaccgataaccagaaactaattgaatggatacaaaattttataatcgaaataactgaaaccgaatggataccaaccgaaatattttgagtaaccaaaaatatctaaaatataaatatatatttacaaaagtattagttatttctagactagataattaaaaatacttgagaatatatataaaatagtaaaaatattcaaaaataataaaaaaaatatctcaaaatatccgaaaatatccaaaaatatccgaaaataaccgaaatatccaaaaatatttaaagcaaaataaccggatggatactaaattttaaaaccgaaataatcgaaaccgaaccgaactttcaaattaaccgaagggatactaaactttaaaacaaaaaaaaaaacgataagcgaatggatataactgaaaccgaatatataaaccgaactcccataactagttattttagtgagaagtttcaacttccaatgtacgaaaagaatgtttggaaaaagtaaagagatttcgtctaaattactagaagaaaaccaaatttgttaaaaaagtataatgtataactttaagaacctagaattaaaattccaactaacaagtttcacaaaaagaaaacgcatactagaattttataaccaaattattgatataaaggtgttatttttggtacctaagttcatgtgacgtgaagagcgacgcatgagagtggcgcagaatttatcaccgtcacttacagagtttgtatctaaaaattctctcaactccatataagcctcaggattataactctgtcattaattaatatatagatcatacttattattaatcaaaacacctaaattaaaaaatcaaataaatcgtcaaatcaacctcaagctgagcagacactatcctcactgcaacgtaagtaaagaagtcatgaagatgcttcgctgccttagcctccggtgaagcttctccaaagcctaattcaattatataacaaaaaaaacattagaaaaataggcattaatctatatagaacaattctgtatgaataaaaaccacattttgtgatgaatatgtcatattgttacataccgggaacatacatcttgttagaacaaatgcgagtttgtttgcattttcgcgaactctgcattaatggataagaaaccaaaggtctttttccaaattttggattaaggtaagagaggtaagagtgatgaaggagtgaagaagatgactccatagaaatattggatgaagaaaaattgcaggagaggcatattgttttactatttggtcgtatataagagaatgtattagattcacacattaaaatatctaggatatggataaataaatatcttctagttggaagtatatagacaaaacatgtcttatttgtttcaatatctggtattgtaatatcaaatatatcaattgggtttatttatttttatcaattttaagtatttttctaataaaacaatttatcaaaaaaatataattactctttgtttcttttgtcagtactagttaatcggtaaaatttattaactaaatgtatgtatggcataattgaaaagagttgtgttcaaatggttgtatacaatgaaaaaattcgaaactctagctttgaatggtaattcattatcaaagctggaagttgtacagttttgatggttatacatttacaaaacttttatcaaaaacgttacaaatttttttattttcagttttattgtacagttttctcgtacagctatttttacagctttgcattatttcaaaaaatttgagagttaaaaattttgtacagctttgtgttacatgttagacatttagtatacatagacaaggagaggtagattatagttaagtttggtatattacttatatccttctgctgttataattctaaaattcagtaaatttaagtggatcatgatcgaacaccacacctttacccacaaacgttggcccatgatcatcacatattgaaaaaaattatattgttacacgtgtaaatacctacgcctagtgattcaaaggtcaaagtcaaaacgctaaaattaatgttctaatttctagatcacatgccatgcgcgtgttaacactgttaaattgtccacaccacacgtgtgaaatgcttatcttatcttcctatattagattcttagtggttcgtgtaactcactcacttctcaccgcgtgttaattatttaactagccgttaggcgttagtatttcgacagtgtggcaacaactgttataataaattctcattaaaaccaattaatagcttcatgaccgaattattccgatgaaaagataaaatagtactacatctttttttttttttttgtcatcaaatagtactacatctgtttgcatgtaaattgtatagtactacatcaaattccttgtatgttcttagtttgtttttgatacatttaaaagggaatatatatatatatatgtaattatactaagttcttaagatattctattcccaaaatcttgattggatgattattattattttaaaatattgataaattttgaccatgtaatgggtaaattatgaaatgccttggaattttactattcatcctacttttattattattatttttatgaaatatacatatcattcaataacattcctaattttaacattacaaaccacaatcgtttgtatcaaacaaaatagaatgaaaaggaggcaaaatacagatatttaaaaatttaggttaatttccagagaatagattttgtggaggagaaatacatggcatatagttcacagtacaacgttatgttttacatctaatagcaaccaccaacatatgatctccatcttctacatatacattttcgctgccattttaacaaataaatcttcaagttggaacttatttacaagaaatgttattgacatttattattatcaaataattaatattcttaattattagcatttacttatctaatatatatccatcaattctaattacttttaaaaaggaaaaatgttaggattttattaacattataatttattaaagataaataatatagttatttaaaatttataaaatatttaggatatttaccgaaaaatgtttagaatatatataatatatgaaatgtattaaattaaataaccatttcaaaagaaaactttaaattgaattgaattataaatcttttaataaaaatattattagaacaaaaaaaaaaaaataatgtttaatttaccgaactagattagatggagagacggatgtagaatattataatgtatgacttttacaacaattaaataaccatttgaaagaagatttttaaattaatttgaattatatatcttttaaattaaagtattattaaaataaaataacaaaaacaaaatgtttaatttcagtgaacgagtttagatggtaggacagatttgggtcgattgtaatacgagatgatataccaagagtgaaatctattagatatgtttagtttcagtgaacgagattacatggtaggacgagtttgagttgatagtaatacgagacgttataccatgggtgaaatcctagatataacaatcaaaatataattatattatcttaaaaacttaacaaaataaatattattaataaaataaacataattaaaatttaaattatttaataataatctagattttaacttaatgaactgtacattattgttcctatatttttaaacagtaaaaatcaaacatagtaagagttatacattcagaaaatacaaaacattaaaggcaaaaatgcttaaaaaatcccaaacaaattttaatttggaagtttaatactcaatacttttggattgaaataaaaatacatcacttaataaattgttgccaaataaaacactgtattttaattattggtcgaatcggacatataagttaacagccgttaacaggcttaacaaattaaatttttatttgtaaaaaaccaaaatagtcccgcgatattcagcggattaaaatctagtttcttgtaaatattcaattcaaacccccaaaaaatacttaatttctttcaaaaatgatttttcaacatcttaaatgtgtttccactctcaaaaactatcgctgatccactaaatttcatatccatccaaatccaagttttacttttacttaaaagcgtaatttactaaaattggtgactcccactcccacatttgatcttaaacagctttatattctcaactttcccctttccataatttaaaaatagatcttcttttacattgagaatcagcatgattggagatggctagtgggcataaaatgttaggaatagaccacataaataaagcataaatcatataattataacaataccttttattggtaattggcatacactttcaagtttatatttggattatttcattagcttttttaaaattaaaatgtagaaaaccacttcctacaattagaagaattttattttaaaatctacgacaaaagaaaatatgttccttttcaatcattctacttaaatctttaggaccaggtttaaacaaacttcatgtcggtatgtctctcattgtcaagatctgaagatttgttttttttttttttgaaagaaagaaagaaagagacaaaacttcaataatttacattttttattctagatgaataaggagtgaaaattcgggtaagcgggtcgggttcagataaaatttgatcggatacggattcttcggttaaaaatgtttaggacccaataggataaatctaaaatattggttcgattttggttcaggtccaattggatttgggttggttcgatatagattttcaggtctttttttaaaccgatactcgaattttcgggtaaataccagaactttcggataaaatttcggatttttgattaaatttaaattttcgaataaaaattcgggtatatttggattcggatcggattcgaattcgattttttggataaagaaatttagaagtcaataaaataaaccttccggttgatttaagttcagataattagattttttggataaagaaatttagaagtcaataaaataaaccttccggttgatttaggttcagataatcagttccggttttttttggccaggcctactgatgaactgttattttggtaacttctaaatatcaaaacggtcctgaatcaggactgataaaacgttaaaaaagaaaaaaaaaagatctactcgtcttctttgtttgttcgttacagtttttacaaaaaccgacagacactttatctcaagagactgggtcaggcctctgttcaatctctatcaaaatccctttcgacatcattcataaacactgacgaatcagtgaaacaatatctcaaacccagaaaccaacaataattcatagattactactatacaaaattctatataactataatctgttctcttgtgtgtttctcgcgtggcttgcgtgttacttcattcatcactgctttagcttctcctcatatgaatctcgaggcaatccagtcactgacttttctcactccccatctctagggtttctctctttcccttattttataatttatttcattgaatctctgaatttcattctcttttgtggagtacatttgtgtaaagcttagatttttatttgggtttcaagcaaaccgagaaaagaaacgattagatctcctttttctgggtttgttctcaaagatttgttctgtttcagttcttccaatttggggggattttatgttggatccagtctctaaaggttcgattttgatgtgtttccttgatatgtaatcagatttgaatcttaaagtttctatctttatgactcctttcaggttaaaactgtgagcatttggagtagcaaaagtaacaaagcatggcaacacttaaagacattggtgtatcagcagggataaacatcctcactgcattcattttcttcataatctttgcgtttttaaggcttcagccattcaacgacagagtttacttctccaaatggtacctcagggggttaagaagcagccctgcaagtggcggcggattcgcggggcggtttgtgaatttggagttgagatcatacctcaagttcttgcattggatgcctgaagctcttaagatgcctgagcgtgagctgattgatcatgctggtttagactctgttgtctatctccggatttactggctcgggtatgaaaaaacttgagtcttattgagtcaaccaattagtttaatgtctcataaagctgaaccattttttgaatgtagattatagagtagagtttgttggtcaagattagataaaaaaattatattttgaggctaattttgtcatcaagaagaggaaattacgttgactaagtctttagagagaagaagcaattctcatgtctgtccattagatttgagtcatttagtagtgaagattttttcctttgttttcttatgttgcaggcttaagatttttgctccaatagcaatgcttgcttgggcagttcttgtaccggttaattggacaaacaacgagttggagttggctaagcattttaagaatgtgacttcaagtgatattgacaaactaacaatttcgaatatcccagaaggttcaaataggtttgttccaccaatctcgagtgtgtgtgtgtgtgctttcaggtgctttaaaatgttggtttgaggtataaaatctcgagttacattgtattgatttttccaggttttgggctcatatcataatggcttatgcctttacaatctggacttgttatatgctgatgaaggagtatgagacagttgctaacatgaggcttcagtttcttgcctcagaaggccgtcgacctgaccagttcactgtaagattcgtttcttatcccttgcttttaaactcataacacagctggtactgatcttgtatgttatgacgttttggcaggttcttgttaggaatgtacctccggacccagacgaaactgtgagtgagcttgtggagcattttttcctagttaatcaccctgataactacctcacacatcaggtaaattttctcattaaacggcttgaacttttcatatgtatttctatggtgtttttacacttcttgaatcaatatttaggttgtatgcaatgcaaacaagctcgcggatttggttagtaaaaagacgaagctgcagaactggcttgactattatcagctcaaatacactagaaataattctcagatcagacctataacgaaggtacttacagtgttaaacgtgatggttctgatgttctgttaagtaataactgtcttctcgcatcgtcttaacaaactcagcttgggtgccttggcttgtgtggacaaaaagttgacgcaatcgaacattacattgctgaagtagataaaacatcaaaagaggtcagctttgtggtctgtctggtttccatttgtgtgccatatgcttaatgttccttttttggtttaaaatctgcattgtttgtagattgctgaagagagagagaatgtggtgaatgatcaaaagtcagtcatgccagcatcttttgtctctttcaaaacccgttgggctgctgctgtttgcgctcagaccacgcagacccgaaacccaactgaatggttaaccgaatgggctgcagagccgcgtgatatatattggccaaacctagcgattccatatgtttctttgactgtgagaagattggttatgaatgtagccttcttcttccttaccttctttttcatcatccctatcgcgtttgtacaatctcttgctaccattgaaggaattgagaaagttgcaccgttcttgaaagtcattatcgaaaagtgagttctcttgttctctaaaattgttccattcttcatgacattaaatatgaggaacattttgactaacagtggacctttttgttcacagagatttcataaaatcgctgatacaaggtttgctagccggtattgcgttgaagcttttcctcatctttctgccagccatactgatgaccatgtccaaatttgaaggctttacttcagtttcattcttagaaagacgatccgcgtctagatattacatctttaacttagtgaacgtctttcttggaagtgttatcgctggagctgcgtttgagcagcttaactctttcctcaatcaatcgcctaatcagtacgtgactctctatctctgttaatctttcgttctttttgggttacaggcttttctaaggactcttctttttaaaaatctgtgcagaatccctaagactattggcatggcgataccgatgaaagcaaccttctttatcacatatataatggttgatggttgggcaggagttgcaggagagattcttatgttgaaacctctcattatataccacctcaaaaacgcattcttggtgaaaacagagaaagacagagaggaagcaatgaacccgggaagcatcggtttcaacactggagagcctcagatacagctttacttccttcttggtcttgtctatgctcctgtgacaccaatgcttcttccttttatcttagtctttttcgctcttgcttatgtcgtataccgccatcaggtaaatgtagtttctttctctcctaaatttgatgaaactggctagtttgataacttgaaccttctgtttatttgttttcttattctcagatcataaatgtgtataatcaagagtatgagagcgctgctgcgttttggccggatgttcatggacgggttataacggcattgatcatatctcagttgcttctgatgggtttgttaggtacaaaacatgccgcttcagctgctccgtttctcattgctcttcctgtgattactatcggtttccaccgcttctgtaaaggccgtttcgaacctgcctttgtccgttaccccttacaggtcagtttcttctacgttatctagatttattatttctgtttagttcgatttttgtcactgtttggatcggttttacgagccccagaaatggcaaaatgttgattattttacaggaagctatgatgaaagatacattggaaagagcaagagagccaaatctgaacctgaaaggttacttgcaagacgcttatattcatccggtttttaaaggcggtgataatgatgacgacggtgacatgatcggaaaattggagaatgaagtcatcatagtgccaacaaaacgccaatcgcggaggaacactcctgcaccgagcagaatcagcggtgaatcgtctccatctttggccgttattaacggtaaagaagtctagtttaacggtttcaattcagtaaaagcatctgcatacgatttaagtatgaatatagttcgtgtatgtatgtacttttatgtgtacatagagaggtttgtgtttttgcttagacgttgttgatgggttttaattgttgaagtattgaagtttcagggtatttttagaataatatcattttaattgggtgtttttcaaacaatgaatttgtggcaatcttgccaaacaaaaatatacgaaatggtcgaatagttgaggcggttagggcggacaaattcatttgcgatttaaaccatttttgtgtacctttcataaactatataagccatgctagtgtaggttgaaaaagatagaacaagttgaactacagaccggttttacttaaagttagtccgtggtggtttattgtccgattcaaaaatagagtggtttagtcgattaacggattagtctgttttctcatgtcatccattgaaagccgaagagtttgtagaagtaaacaaaaagatataaacaataataaaacaagaattgcataattttgtattcaacagaaattataaaaaaacttatagaaagccacattacagtacaagaaatcattcttatatctaataataggagaagtacatgatttttcatcccaaaaaaaaaaaagaggtacatgatttacacctcgtcgatatcctaacgattaaaaaactgtaactactgattttactacagtatatatgtatcgacaacataacaatgtcgtgacttatatactgttgagctcctaagaaaaaaataacgctattattgatttcacaatagtagcaatctcaactccatagcgaatgacgtagagaaatgtaaccaagacattttttcagaaactatgatcgatatatttcaagaaaggtagacaaaaagtgagaggctattatgtgaatgaagtaaaaaagtagaactattgaggctaatttatagagaatgaattgtaaataagcaatgcgatgggctgcaaactcttctcgtaaatctgcaaatttattaagacagtgcacctaaatattaatgaagagagttaatgaatcaataaatttgaacatcgtgacttgttaagtttggtgagaggggaataaggaacgttctatatgtaaagcaatgataattaagagttaaggagttcatagttcatgtttttctctagtttggacttgagtccaaaatccaaattaatccaaaacaatgttgagcctaaactgtcccaagactcccaacaactcaggaagctcttgctgttttccttttaatcattgtgatattacattcttgatcgtcccacagggaaaatattttagccgttagaccaaatgataaaaaactgtaactgttgatgggaacggcgtcgtttcgctaaccttcgttttaactgatctcaattctcaaggttcaaaagagtacacacacacttatctcaattatccactgaaacattcgtctccggcgaaacaaaaccagaatgagctctcatcatcaaatcctccaaattcgttctgacccatttgttctatcacactgttgccgccacacacgcctcaccagctctcttacgcttcaatctcctctaaagcagcccttttcatgtctccctttccgttggcgccgctcttatcgcggcggagtcaggagctcaacgacggagactcatggtagcaaaaaagaagctttggtgtcggaaacggcgactacatcgattgaattgaaaagggtctatccatttcacgaaattgaacccaagtggcaacgttattgggaagataaccgaattttccggacaccagacgatgttgatacttcgaaacctaagttctacgtcctcgacatgtttccatatccaaggtctcttccttttaatactgattatgtagaaagttcacagatttggctattccagcttaaagaaatgaactttgtggttttgagaagtttccattgatttcagtagcatccttggttaggattttgaatagatgataggttttcagattttgggttttgtggaaaagatgaaatttttgtgtgtgttttgtggtttgttcttcagtggagcaggattacatgtgggacatccattgggttatacagcaactgatattctagcgaggcttaggcgtatgcaaggttacaatgtgttgcatcctatgggttgggatgcttttggattgcctgctgaacaatatgctattgaggtccattttttttctctgttctcaagtcattatgtatggatgtttttgttgataaaatttgtgtccttagtatttgtaatctgcattgcagacaggaacccatccgaaaactacgacattgaagaacattgaccgctttcgattgcaggtgatatatttctttcaatctagcactagcctagaaaagttactattctcttctattcatcatttccctaacagaagaaatttctcagttttgttatcggtttcgttgtgagaaatttatgcttgtttcatggtttaggattactgatccttgaagattatgcaaaagccattactttggactgttttgcttaggtcttaccatgggagtaaagatctggggaccttaacaattgtagttcttttgtttgtttgcagctcaaatcattgggcttctcatacgattgggaccgtgaactttctacaacagagccagactactacaaatggacacaatggatctttcttcagctttataagaaaggtttggcatatcaggtcaacaaaatcaatgtctagttcacatgttaaaaccgtgcatttgtgtatagaaaagttctttgaaagattgtaaactcaggctgaagtaccggtcaattggtgcccggctcttggtactgttttggccaatgaagaagtggtggatggtgttagtgagcgtggtggccacccggttataagaaaggtactatctattaccatctgggaatattatgtcgtttttcccctttcgaaatctgtatttcctctgttttgaaaattctcatgaattttacagtgacattgtttattaccaagcagccgatgaggcaatggatgctgaagattactgcgtacgctgatcgtcttctagaagatttggacgagcttgagtggcctgaaagtataaaggaaatgcaaagaaactggataggaagatccgaaggagctgagttgaacttttcaattcttgatggggaaggccgagaaactgacaaagagattacagtgtacaccacgaggccagatacactttttggagcaacgtatgcttaaaggattaattatatattcaacatctgaaatcttgatcttgattgtcttaatatgatatttgcttccattcgcagttacatggttgtggcaccagagcatcagttgttgtcttactttgtaaccgcagaacagaaacagcaagtaagagttttttcttctttcgattattcaacttgcctttcagattttcatgagttctctcttatggttgcaggttgaggaatacaaagatttcgcttcgaggaaaagtgatcttgagagaacagaacttcagaaggacaagacgggcgtatttacgggatgttatgcgaaaaatccagctaatggagatgctattcccatatgggtagctgattatgttctagctaggttagtttggtctaactgtttacattgccttgaaatgaatttgtgtgaaacagagaacgttgttatatgtgacagttatggaaccggagcaatcatggcggtcccagctcatgatactcgggataatgagtttgcgttgaagtataacattcccatcaagtgggtagtgagaaatgaggcaaattcaagtgatgatgctaagcaggtttatcccggattgggcattattgaaaattcttcaactttagaaacaggacttgacataaatcaactatctagcaaagaagctgctttaaaagttattgaatgggctgagagaactggcaatggaaagaaaaaggttcatcttcatgtctttctcatttggattatgtaaaaagtgttctacttttcttacacaaaaggtttttggcaggtaaattacaagttgagggattggctatttgcacggcagcgttactggggtgaacctatcccgattttaattttggatgagtctggtgaaactattgctatttcagaatctgaactgcccctcactttgcctgagttaaatgattttacgcccactggaacaggggaaccaccactgtcaaaagcagtttcatgggtatgttttgcggttaatatgattagtttttgggtatgcctatgccatggacattttggttatgatcgatgactttgcaggtgaacactgtagatccttcaacaggaaaacctgccaaaagagaaacaagcactatgccacaatgggctgggtcttgctggtagatatttacccttcttaattcttgtatataacctcctcattacaaaaaatgtatctcccatttgagaatccttgatgctctctcatagtgatggttctaggataggccgaattcgatcttgaaccttgttgaatatagtacccagtgtgttgttgaaggatgttgattttaatactgagaaactgaacaaaattacatgatttttcaggtactatctgagattcatggacccgaaaaaccctgaagcattagttgacaaggaaaaagaaaagtgagagcatttcagaatgcaatcattatgtgccatctttggccagatctttaagtttttattttggtgtggcagatactggagcccagtagatgtatatgttggtggtgctgagcatgctgttttacatttactatactcgaggttttggcacaaggtgtgtatcctttgaaacctccctttctttaagttatattgtgatctaactacaaattttgttactgcatcattccaggtactttatgacattggtgttgtgtctacgaaagaaccattcaaatgtgtcataaatcaaggaatcatccttggggaagtaagtcgtcttttgcaccgcctttttcaaatttactcattccgttgaatgttttctgcttaattgttttacttttgcaggtccaatatacagcttggaaagatcaagaaggaaattatgtatctgcagatactgaagaacggttaaatgaacatcaacaagtgacaatcccggaagaaaaagtatgaatcttcattctcattcactaaaactgataagctctccagtgtttttaatcttatgatctttaatggtctaggttatcaagtccggagatcattttgttctgaaggaggatcctagcattcgtctgattccacgcgtttataaaatgagcaaaagtagaggaaatgtcgtaaatcctgatgatgttgtattagagtatggtgcagattctctacgtttgtatgagatgttcatgggaccatttaggtatatctcaatcccaaatttgttttttcgggttttctcgctttctcaatgtttatatctgccttcatttccttctactagggactcaaaaacttggaacacgagtgggattgaaggtgtgcatcgtttcttggcaagaacttggagactagtcattggtttgcctcagtctgatggttctttcaaagatggaaccttagtaactgatgacgaaccaacccttgaacaactccgaactcttcataaatgcattgcaaaggtcatctcatccccttatgatctctttgcggtttgtttacatcttacttaaaataggtatgtaaaatctgcaggtgacagaggaaatcgagagtacacgattcaacacgggaatttcagggatgatggagtttgttaatgcggcatataaggttagtcttagactcttatatcggtcagctttgtgttttcactttacaagtactgatcttttctccggtttcttcttttactttgacagtggaataatcaacctagaggaatcattgagccttttgttcttttgctctcaccttacgcgcctcacatggctgaagagctttggtcgcggttaggccatccaaattctctggcctatgaaagcttccctaaggtagagatagtaaactgaacatataaacacaacacaggaaggtgttttgcggtactgattgttgtggtatttgtgcaggcaaacccggattacttaaagaacacaactattgttcttccagttcagataaacggcaagacaagaggcaccatagaggttgaagaaggatgctctgaagatgatgcttttgttctagcttcacaggacgacaaactcaggaaatatctagatggacaatcaatcaagaagcgaatctatgtgcctgggaagatcctcaacgttatcctagaccggactaatgtcaaggtcactacaaagtaggatttagaaagaagaaacaattacaaaacctgtcaaatgaacaaaattttatctctattgagagtttccattatatagaaaaagattcttttagaagcaaaagatctgttcttagataacatcagaagcaacagttccttctttccatcctccttgccgagctcgaagctcccacatgtaagaaagtcttctctgttcatctagagctgcttctgctttctctcttgctagctcacatgtttccatccccatactgcatttatcagcctctttctgatactgagacgccgctttcttagcatctagcagcaacctatctgcacgccattcgtcttcttgagcttgtgcttctcttagcttcagctcttcagctaccatttcagtaaaactactctcgctctcttcactcccttcctcgtgcctcatgcaatcttggcaatgaaacaagatccaaccaaaatgcacgtgaaatctgcgacgttttagcattcttactaaatatataaaaagttattaccagaaaaatactcacctaagaaactgtgattgcttaatcctgcagaagaaacattgaatcaaacgtttcaaaagttgggttttgtgaccagggaaagaagaaaggaaagacaacgataatgatgatgattaccgtcgggaatggagaggagaggctgagaagaacaatcacatacacaaggaggacaagaggagtggagagaatctgcaatggtctcattgagatgccaatacagagacggtcctgcaatatatgcgacaatacacagtcccattaccactgttaccaccttcgccgtcttcttctgccttctggtcatctctctctatttctttctctctgcaaattaatggtgtcttctcttttgtttgaatcttagaagattctcagtaactgttctccttgaaatgtcccccaagtattggatcctttcaagacttcacgcatcattagatcctatttttagcagatgctttgcaattataaaatttatgtcataattctgtttgacactaattatttgaaccaaactgcatcatttccctgctaagaagttttaatagagacactgtatcatctgaatgtgatgtatgattcatgaaaaatgttgtggttttcccgttcatctcgattttgctccatcccgggagctttttcaagccgagagacctcatctgattccatgattcactcacatcgtcccatctcttcatcgcagcaaaagaatgtcctagttttacgtaatgtccagcgtcccctggcttcaactcgatcatatcctcacaaattatatcttcgacctctgttttcccatttgcacggcaagcatcgagtattatacccaagacatcaatcgaaggtctggtaaagttctctttgtagaacttgaatgcgtcttctattcttttagctctacatagaagatcaaccacacaagcaaggtgttcgtgattcggttcaacaccaaaatctctgaccattgaactgaatattttcaaaccttgttgaaccattccattatggctgcaagatgagagaactgcaagaaatatcacgtggttcggctccattccagagtgaagaaactctgagtaaatttccaaagcaatatcccctttaccatgaaaaccataccctgcaatgagtatgccccatgaaacaacatctttccacgagatcgaatcgaaacacctctgtgcagcttctaagtagccacatttcgaatacatatcaactagagctgtatcaaccaaggaacatggcctgataaagcttctgattacaatacagtggatcagtttccctacagggagagctccagcagatgaacaggcttgtaaaagtgagacaacagtaaatgaatcaacttgttgcacggttttgaacttcatttcttcaaacaataacaaggccttacacagatctacgttctgggcatatccggagataatcgcattccacgaaactaagtctctttcattcatccgttcaaagataactaaacttttatccaaatgaccgcactttgcatacattgtgatcaaagagttcaacgcaggagtgtctagtgtatatccatgcctcagtacatagccatggactgaagcgccaagatcaaaggaacccaattgagcacaagatgctacaacactagctattgcttcactcgacaggtctgatcctgattgtaacatttccgagaaaacaatcagtgccttttctgctctacccaaccgcataagtcctgatatcatgactgtccagcaaacaacatccttattgggaatcgtttcgagtacccgatatgaagcttcctcctttccacacttcaagtacattgttatcaatgccgtcttgagatgcatatctacatcaaaaccagtttttacaatttggcagtgcaacattcttcccatttcaagatcacacattgttccactcactgaaagtgatgctccaaatgtctgctgatcaggtcttaaaccatcacctctcattctgtacaaaagcttcaagatttcagacatattaccaacagaagcataccctgaaatcattgtgttccatgaaaccatatctcgttgctccatctgatcaaataaatccttagcatctccaacatgatcacacttgcaatacaaattcaacatagagttcatcacagctatatcacaatcaaaaccataaatcacagcaaagtcatgtaaacactgtaactgcgtaatctctaaaaccccactcaacatttccaacaacgtaaccggacccggtttgatcccctgaaatctcatctcgttcaccaacgaacaagcttctccaacaattccagcgcgtgagtaacacccaatcatcgcagtccagtgcaccacatctctctcacgcatttcctcgaacactttccgagcatgagccaagagtccaaatttcgcataaagattgaccaatgaagatgatatgtagaaatctgaagagaacccattaacgagaacctgctggtgaatcgagagaccaaaagagaggcgctgaagagaagcacaagctttgagaagactagggaaagtaaaagtatcaggtaagagtttattggcgagcatggaagagaatgttgagagaacttgcttgtgatcgccatgagatgataaatggttaatgtgagagttgaagtacttggtggagttcaacacagacgaagttctgatcatagctccatggttacaattacaatgaaatcgtctccatatcaatcttattacagtcacagaagaagatattgtatttgtgtaatggtttacttatcaggtttatatcaacccgaaccaaactaaaccaaaccgaaccaaaccaaaatttcaaactatttttaattacgaattattattactcttcggagtaggaggtaactaaaaaccctaaagtcaaaaaaccaaaccgcacctatcgatgtcggaacttccagaggatatcgtggaggagatacgatctacttgcaaaacatggaaccatttattcaacgatacaagattcgcaaaaaagcacttcgataaagccgtaagacaatatctagctctcacgatcacaaaggaatttagggtttatttgttgaactttaatctctatggatgtaacaggtgaacttagcataatcaattctcattcttatttaaacttagctgatatagaggaagttttgcactacgatggcttattgttatgtaccattatgagaggttgccctagactcgtagtttggaacccgtgtactggtcaaaccaagtggattcaaatcaattcaagttgctactacggatatgctcttggatcttggcaagacaaggaattcagaaataataatagctacaaaatattgagctataattattttgatattcacaagcaaaacttcgctgtgacataaagtctaattcatggaggaatcttgacgtcactccggactgtcgcttagtgaatgctagtctttacagcgtatctttgaaaggaaggacttactaatttgctgctccattgacaaccatctttcggaagagacacacctcggcttagtcagttttgattataaaacagagagatttgaacgtatgtgtcttccgtcgtgtcacatagcaactatgttgggaactttggctctctccgttgttaaagaagaaaaacttattgtgttattacatggcgcaaatacatcaaagacagaaatatggctaacaaataagattgatgagaccaaagtggtgtcgtggagcatggtcttagcaatggatcaccttgagtttgatatttggtctaacgtaaggcttatttttgacgaggagaagagattcggtgtgtgttgtaatcggaaacgtagggtcaagaatggcaagattcactgtgaatgcatagtacacataattgaggaggataataaagtgacaaaagtggattttgcagcatctaagttgtcatatctgccacttttgttcaattatgttccaagtttggttcaaatccagtgactttggagcttggaggcaacatataaagaggcatgtgaatcgttactctatcttttgtagttttctttatttattctggccatgccctttgaacaatttatagatcgacattcacttaggaagttttattatttaacgtctcaactaccatacgtagctaacatacgttaaattcatgttttcttatatataaaactgtgaagaatatgatgacttgaagttcaagaaaggtttcaaatgtttaaagcaaagatccgttgagacttaactcaggtgaagtaaatcaaaccctggttgagttagcttttggatcacattcatggtgaaccggcaaaaggaaaattgccgccactcagccatagaggacaagtttgtctgtatgtggtgctagctgttaaggagtgctttaacagacgcggtttcaagactgtacctttggcgtttccatggtgcaagagtgtccgcgtcagcacaagggagccctagttatattcagtataaaagaggtgctctaggttattaagagatgtagagagaactaaggcggctgagagatattagaaacttgttattatcataagcttgtaacagagtttcttaggtctaggagagtgatatagagtgagcttgaatactagtgaagggtatcgagtggtcacttgtaattctccttgtaaacactatctctgatttagtggattccgagaacagtctcgtcccagacgtagcatctattgatgtgaactgggttaccaaacttgctgtgtgttctctgtttctgttcttgcactctcattgttcttattttcgggtctacttgtgttctgttctcaacactgttgtaacaacgacaattttcttgcttgtggtgttgtgtttggtttgttctcaagaaaagtcgacgttttgagtgatcaaatccttacagattggtattagaggtttggttacagtccgtttgtggttccgcagtgttaacaaacggttaaaccatgtctggagcaaggatataggttgagaagttcgatggtcgtggagattacacgatggggaaagagaagctcatagctcacagtgatatgttgggcttgagttctgttctaagagaagctgagacgccgatggggaaagatagagattcagagaaatctgatgaagaagagaaagaagaatgtgaaaaggtggaagcttttgaagagaaaaagaggaaaactagaagcaccatcgttttgagtgtttcagatagggttttggaagcctcggataggctctacatgtctaaagctctcccaaaccagatatatctgaagcagaagctctatagattcaagatgtctgagaatctgtctatggaaggtaatatcgatgaatttcttcatatagtagcagatttagagaacttaaatgttttagtctctgatgaggatcaaaccatattgttgttgatgtcacttcctaagtcgtttgatcagttgaaggatactttgcaatatagctctggtaagactgtattgacacttgatgaagttactgctgccatttattctaaagagttagagtttgggtcagttaagaaaagtattaaaggtcaagcggagggtctgtatgtcaaggataaggcaaacaatagaggaaggagtgaacataaggaaaaggggaaaggaaagaggtctaagtctaagtctaagtctaaatgaggatgttggatctgtggagaagatggccatctcaagtctacatgtcccaacaagaacaagcctcagttcaagaatcagggaaacaacaaaggaaatcctcaggaggataaggaaatcttgttgaagcctcagtaaaattttgttgaagctgcaggaatgtttgtgtcagaagctttatcctccactgacattcatttggaagatgagtggataatggatacaggttgcagctaccacatgacccataagagggaatggcttgaagattttgatgaagaagcaggatgttcagttcgaatgggaaacaagactatctcacgagtcaaaggagttggtacagtcaggattgcgaatgacaatggtctcactgtaacattacagaatgtgagatacatttcggatatggatcgaatatttttatctttgggaacttttgaaaaggcgggtcgtaagtttgaatcagaaaatgatatgttgagagttaatgctggtgaacaagttctgttggagggaagaaggtatgatacgctctacatactccatgggaagcctgcaactgatgaatcacttgcagtagctaaagcaaatgatgacattgtgttatggcatagaaggctatgtcatatgagtcagaaaaacatgagcttgctagttaagaaaggatttcttgataagaagaaggtgtcaatgcttgatacgtgtgaagattgcatctatggaaaagctaagaagattggtttcaacttcgctcagcatgacactaaagagaagcttgagtatgttcattatgacctgtggggagcacctacaatgccaatggcattagggaactgccaatactttatatcattcattgatgaccatacaaggaaggtatgtgtgtatttcctgaaaacaaaagatgaagcctttgagaagtttgtaagttggatcagtttggtggagaaccaaagtggtaacagagttaaaactctgagaacagacaatggtctggagttctgtaaccggatgtttgatgggttttgcgaagagagaggtatccagaggcatagaacctgcccatacacgccacaacaaaacggagttgttgaacgcatgaacagaactatcatggagagagtgagaagtatgttatgtgactcaagactgcctaaaagattttgggctgaagctacacatactgcagtgctactcatcaataagactccttgctctgcgaataactttgagtttccggacaagagatggtctggaaaagcaccaatatacagctacttgagaaggtatggttgtgttacattcgttcaaactgatgatgggaagttgaatctgagggcaaagaagggagtccttattggatatccaagtggtgtaaagggttacaaagtttggctgattgaagaaaggaagtgtgtagtgagcaggaatgtgatttttcaggagaatgcagtgtacaaggatctaatgcagagaaaataacaatttctctatgaagaagatgaccacaatgggtcatacattgacttagatctcgaagctgaaagagatatcagctcaggtggagaataatcacaagctcaagtcacacctgctacaagaggctcaatgactagtacaccaccaagaaatgaaactgatgatattgaagagactgatgtacattaatctcctcttagttctcatctggtgcgagatagagaaagaagagtaatcagagcaccaagaagatttgatgatgaggactattttgcagaaactctatacacaacagaagatggtgatgcaatagaaccggcagattacaaagaagctgtcagagatgaaaactaggacaagtggaaacttgctatgaatgaagaaattgagtctcaactgaagaatgatacttggattatagtcacaagacctgagaaacaaagaatcattgtgagcagatggatatacaagtataggcaaggtattcctggagttgaagaaccaaggttcaaggcaagacttgtcgccaaaggtatgctcaaagagaaggcgtggactatcttgagatctttgcaccggtagtgaaacacgtttcaatccgaatcctactttcaatagtggctcaaaaaaatcttgaactggagcaactggatgtcgaaacagcgtttttccatggggaattgaaagagaagatctacatgatgccgcctgaaggatttgaatccttattcaaagagaatgaggtatgtcttcttaacaagtctttgtacggtcttaagcaagcacctagacagtggaatgaaaaatttgatcattacatgactgaaattggtttcaagagaagtgattatgatagttgttccaccatgtatttgttgttatatgtgtatgatatgcttgtggcggcaaataacatgcaagccatagacgcattaaagaaagagctgagtaataagttggagatgaaggatctcggagcaactaaaaagatccttggtattgaaatcatcagagatcgttaagctggtgttttgtggctgtctcaagagagttacttgaacaaagtactcaagacattcaacatggtggaagcaaaaccagcattgactccgctgggagctcacttgaagatgaaatctgcaactgaagagaaactgagcgaagaagaaaagtatatgaagtcagctccatactcaagcgctgtagggagaatcatgtatgccatgattggtacccgtcctgacttagcctatcctataggcgttgttagcagattcatgagccagcctgcaaaagaacattggttaggtgtgaagtggaaactaaggtacatcaaaggaacgttgaacacaaggttgtgttacaagaagaattcagacttaagtatatgtggttattgcgatgcagactacgcagctgatctagacaagaggagatctacatggttattttatatatggcgggattagttttactcttttgttttatattccttgatccaacaccgcagtctctgcagaacataagctttactctctcttttttttgtcaacttataaatttatgacttaacttttgggtaagtcaataaagaccaaaaaaagacatacttagttgaaaaaagggaatctacactatctgaccatagaagagttgttatttaagtccatcaaatacacactgtttcgataatgtctgtagcaaaattattacatctaaacccctactcctctatcaaatcagaagtgagatatatactaggcgtgtgtcagaaccgagacatcatatcttcaaagatttcatttttcgagattttttggagaataggtgtgataattaacatgagaacggttcaaattctaagagttgtatgtgttggtatatgccttctctctcatttttattgtcccctctatccctttctccgttattctccagttttgttcctccagaatccaaaacaatatcaccgattgaagctcggcgtttcccatttgttttgtcgaggtaaccatataaagtcgaagcagttgtcgattcttaattccggttcagttcgatttgtgttctgaaataaatttctgggttttgtagatggcggctcctgaactccctcatcgtataatcgctgccggcgaagaagttcttggggagagggcaaatgtttacaacaagatgaagattctacatggcattatcgacgcattagaggaagacgaaatccggctcatcaggaactctcctctcggtgggttgttggattttccaaacaaacccgcctggtctactactttcgggctttatctgcttggtcgcaagttggacattgacaaagccaacgagatctgggtagtttatgctggtacacctgttcgattttctctgcgagagtttcatttggttactggccttgcttgtgggcgataccctgacttgccaaaaaaacgaaagaagggaactgctgagaaagagattccgttttacagcactctgtttgagcttgagtctgatgttactgtatctcgtgttatcacgatgcttaagaagaaggttaccgacgatccgtctttgcggattcgttatgctgttctcgctctagttgacggctacctcttgcccacatcacattatcccaaaattgttaaagagcacgctgagatggtggaaaatctgtcttcttttcttgcttatccgtggggtcgattgacatttgagatgaccatgaaatcgataaaagagagagaagtcgagcagcttgcaacaacttctgttgatgtacaagggctattatacgccctacagcttgttgtgcttcaagccgcaccagctattaaagaaggtcctgtgtctgaggacactgtctgttctgagtcggacgaagagactttggaactgatacctcgacaggtggtcccgtttaagcttggaaatgcgaaagatcttgacaacaaaggacatgtgataaatttattagtagatgataatgtttttttcccgttaacattttcaccaggttatctgctaaatgttcagcgaccggtgtaattgatttgttaccacgctgtttttgcagactccggttgatccaattatacttcctgaagccgttattgatccggcccaagatatttcgtggtcagatgatgaagcagatcctcgtgtagacactatggttaagctggtcgccgaaggtttcaagtttaacgatgatatgttccctgggggttgtgttccttccgaagtggtggtggcccccaaaaaacgaaaaaaatctgcaatgttgaaaggtggtcggggcagaaaatcggccaagcagggcagatttaagaaaaattcaactgggattcggaggacccaacagaactcgattgatgaagaggaatctattgttaacgttgacatgaacgcgttatctcggatgttagatgctaaattggccacgcagtacaaaaagataatgaaaggtgttactgattggtttatcgcaaacacttccatatcaactaataatgggaaagatatcccttctgagaatggggtagaagctcctgctggcaatgggaaagataaagatgttcctctgacccgtaataatccgtttcccaactcagatggagacgatgattttgaaattgtcccccctcttcgttcgcagacccgtcgttctacacgccttggcaaacaggcgaaccgcggcagacaagtccccgagggtgcgagagacgataattttgttgatgggattgccgctgccgttaactcgcaggtaacgcgttacctgaccactacctttttggtgatgtaattcgacagttgttgatatctttttacttattggtagatattaccggaggtagactgttacttctcagtgctgcccgatagcgtggtttcttccgaggttcgtcttctttcccattctttcctgtgttactattgcggacccatcttacagtaaatgtttctgcctttttttacagtcctgtggtagtggtcagtcagattctactttaccagatgacgaggtttgcgaattatggttttattaagcttagttgataaatttaatggtattgtaaatatccgacttgtttacagaaacatgatacggaaatggcagatgttgtccataaagataccggtcatacagaagaagaggaagaggtattgttaaataatctcgagtaccaggtaattggagtacccatctttgcatgattcttttgttatacgatacaggtattaagtgttgggaatgacgtttcgcgggaggatcatgaatctactaaggtatattattcattttatttatattgtatatcatatttaactgattttttttattttacattctaatcattttgttatcggtccatagcatccccaaaatgaagatcaagggaccctggaggtttgttaattttatgaaaaatataggttttacttttatatacatatttattccataacatcattgttaccgtttacaggcattaccaagtgtagacgagataccaaaggaaggggaaccccgtcaggtaattgtgttttttatcatttgagttcgtcatctcgtcaccttttaaacactcagtgtttggtccactaaacgaaattattatttgtttatagggtacccaaggtggacaacaagttgacgcatggatttgtataagactctaatttataatttagcttttaatataaatattatagtctaaccagtttgttatttggtatagggttcccaaggtggacaacaagctgacgcaggggtttgtataagactttaatttatagcttagcttttaatataaatattatcgtctaaccggtttgggttttggtatagggttcccaaggtggaccacaagttgatgcaggggtttgtattagattctaattcatagtttagctttacacatatatattatcgtctaactcttatgttatttggtataggaaagtatacggggagaagtttcaccggtcgtaagaggttctattcaagtaattgtctttttttttttccacctgaaacatcaacctcatacagtttttttactatctaaagtgttagcattgtaacataattattatggtatatttttaatgttatctgtataggaattaacaagcgagaagttcgaaccgagggtagaggatctattaaggtaaaatccattttgaataatggttgaaaatattattttaggaccgacctaattaaagtataattggattgctaaactaaaagttatatggtaacagattccaacttacggaaatgcttcccagatggcaattgtccagcctcaggttgggtatctaactcatagtcattatgattacgttgatttattttatatattacacttttttgatgcaggcggatgttctcactcagactagtgttgttggtaataatgcagggagaaggagtaaaaggcttagaaccagatcaagcaagttggatggaaggtttgccattgacaagaaaacaaagttattggtaggacacacgtctcctattgctaatatttcgagagagactgtagattctgaaaagcgttataaccgctcattgaagaaactcaaagccatcaggtaaaattattacgtggtaactatttgagtaggatagatcataaagattatccggaagtctaatattttatttactcgtgacttagctctatttctctggttggtgatgttacgcttagtagtaaggatgtcctggagttaatcgagaggaaaaaatcgttgggaaacaaggttacctttcgcatatcaataaattttagataacttccttatttacccaataataattagttttccttctttcttgaaggtaatggacggattgttaaagtttagcaggcatgtcctccgtactgacgtcgtcgacggccacaagcttcgtgttgatgtgcttgataccaagtttatctcccaattgtgccgcctttacccgaagttcatcaaaactcctattcctcaagactttgagttcccttcatctttgggtcgaggccgtttctggcgttggcgactctgaccgtgctcagctgtttactgaagttgatttcctctatcttccattcaactttgataagaagcattgggttgccttgtgtgttgatctcacatgctttaagatcattgttctagactgtaatgttcatttgcgcacagattccagcatcaatacggatcttgaaccaggtgccagaatgcttcctattctcttcaaacaggcggctctcaatccaacgatgactcagctatccccgagtccatttgcaatggaaaggtctctcttcatcccacaggtgaccaatcacgttgacgctggcttgatgatactctttctcattcaggcacacgctgtcggtggtatggacgactgtgttgactattctattgattccattgaagatgaaaccaaaaagcttgtttcggctataattctcgctggtgttccttagctatcctttactgtttcatgtatgagatttggactatgttttttttatgctcgctggattatgttctttattatactcgataaaactagactcgttcgcattttgatgttttttgtatttcaattgtctatattggtcgtttaacataagatttaccggataaatttgatatcatataaataaatgtttactaacctattaaatcatatattttaaaactaatacgtgtatcccaatgctatacaaacagtacactctcaccataatccgtatgttgccggttatactaagcagatccttcacgtgtggggattaataataccatcatgttaatatatttattacgtgaatataatgaataacacgattttcaatctaggtcaatgagaatagtgtcgtaaaggtaagtcattgtttagatgcgtgaattaattattttatcgtctaacacggcctccggaaataaatttgttaccgtctaagagacatataaacatatgaacctgttaccttaattcgggtcgcgcacgtcttttcagcgaatttgtaggtagttaatagatggtaataattatattagatcctaattcacctgacacgatagattctagtgttactatgtaggatataaattctagtgttactaggtaggatcatagtcgtgtaggaaataaatttgttaccgagtaagattcatataagcatataatactttgcgcgcgtcgctttaaacgaagtgtatgtggttcatgaatggaaataatactattatattataattcacctgacacgttaataaaatatttaggacaatttccagcaaattcaatgtaaacactgaagcaaaggtctgtcgagcatcttgataactttgtttctggacaagcggtctataaacatatactgtcaatttagtctgtgttttgcttgtgttaatatgtaatattgtttacgagaggcactataatactacttatgtctaactcggtacaaaacgccgttaccgcgttcatacaagatatagcatgacaacggtttacgttggtaacataagatgaaccttttcaatctgataattaaacattaacttgtttcttataaaacattcattacatcagttaacggatgggtatctcctccgataattatacatatggccactagaatccgctttatatacaacaaaattattctaatgacaccatcatcattatttataaaacaccacgttgagctgatctacttgcccatcgtcttccatctgtattctcctccgccaaaaaacttgccttgtcatcattctacgggtcatgtttgttaccaattctgttattaatatttccatatatttcactgcttaattaaataggatttatgaagatattgttaccgtgatcggtcccttgcatgtggcttgattgtggcccatggttcggcagcgtgtgcaccgtcttcccgactttctctgaattaccataaattccatacaaatcactaaccatgataataatattatcattcacattacttaccaaataactttaatattactttgaattctccccgagagaatagccttattttccttgggcggcctgctggccttttcacatatggcggggctagcttccctcctccgacatcatttggtgatggtgctagtgtagccatatcaggtaccggcataatcaattccttatatgctaacagtagttgtggcacggtgtgctgtactccaacaaatgtgtcaacccttacgccttctctgattgccgcggatattgcatgtgaacatggtattgtgaggagctgaaactgtctgcaggtgcatattctttcccacagattaactgcgtatccgcattccatcatatcccttacctcatatagaccatccccgattttcaagactgcataacttgaccccttttcaaagttctcgataaccatttcgttaaccttgggaggcaatatgttgtcttccatttgagctgcttctcgcctcagagcaaaccacgttaccaatgttgttctccaagattctaggatcgatatcactggataatcccttgtcattgtcaaaacattgttcaaacattccgcgacgttgcttgtcatcacattgtacctctcgccaacaaaatgagaccgtgtccaatattcaaaccctattccggttaggtagtctgcacatggaccgttaactgctcgtatctccgcaaatatcttattgaagtcacttaggcggtaggctcgtgctgccattgaaactaaacttcctaaaccttcgtttttgaatatggtgataatgttccttttcaaatgaaccacgcaagccgcgtgtgaggacattggatacacctgggtatgtagacaataaatttttcattagcccgataagtgttaacacgataagtacttatctacattattcaacaatgttatcctaatgtctttgttttatgtacttaggtattctattttctaacttcgtaatatataataaaattactagttagaactcatatattgtttttgccagtcaaattaataatccctataacataacgacgagaatatagttacctccgtaagcggttatagtgctaacaattaagttaacaaagtagtgtacctttcgaatacttgcgtagatggaagcatgtcggtctgagacgaacactaggtctggctcgtctgaaacaacttcggttagcttgttcatgaaccaggttcacgcctcatcgttttcactattaacaatcccaaaggctagtgggaaaacttggaaattcgcatcttgggcgcttgcagctacaagacaccctccgtaccgtcctcttaagtgcgttccatcgatgacaacaacctttctcatgtaagcataccctttgatagatgtgtgaagtgcgaagaatagatatttgaaacgaataactcccgtgttatccgtttcagtctctaacgcggtaatggagtttgaatttgttgccattaggagtttgaaatatggctggattaatgcaaaactccccatagcggaccccatagcattgtctatggctatgtctctcgctctccacgctttctagtacgaaacattgaggctgaactcctgcctaagcattcttcgcagctcattaggtctaggccctctacccccaccaagatacttggtgcacatcaccttccctataatcgcggtcgatgcttgcttgtggaagtcccccctggcgtacacgctgcaggtgtgctgcagtatcgccgtcctcacttcaaaccgttcagtatcatctaactttgttgcataaactcgccatgggcacgtggtgccgacgcaaacagctatcaccatagttggacacgacttggcatgtatgaagtggaactttcgtcggatagcatgtattgctagttttgtgcaacagtcgtctttgtttttgaacaatcttcccacgaaaatatcatccccttcgtagttagcatctttaatcgctcgctggagagcatctgtcaatgacaaaaacacaaaaccattaacgcgatatgttgagatttatcatttagttatacaggttaccctgatattctcatcattactggatattaccttcttcacccgggtcatcgaaataggagggtgcatctcgatcatacaatactgttggtactggcgtgtccggaccgtctaaaacaaaatcgtctccaaattaggcatgaccaaaatctaacagtaaccgtatttcgaaccgtaaccagaccgtttattaaccgtaacccaaccgtaaccgtataaaacggttaataaccgtaaccgttaactgtgaaaatagatccattacggttaagaaaatatactaaccataaccgttaattaaccgtaaccgtatcaaaaccgtcggttaaccgtacggttaaccgcgtggttaaccgtattgttaaaaccttaaaaatatagttgtaactgtgtataattctaaataaataattatttcactaaaatagtaactgaaatcgtttaatatgtccactactacgatcgaagttactcaactactctttttaccataaatcaaatcataaatagttcatattattattatttatactcttaaaactatttcttaatgctcacaacatcttctctttaatattgtttttgtttggaaaatataattaattcaatcattataattatggccattaatttgtttattcattggtttatttaagaaaaatagatagctgatacattataaatatttgaaacacataattacgtaaaataaatattatttgatatatcactatttatttatttattttattataaagattaaaaaatataatattttgtctcatatattaactatattataattatcaaataaccgtaacggtatttaaccataaccgtatttaaccgtaaccgtatttaaccataaccgtatatataacgattaaggttaaggttaaaatatatttataaccgtaaccggtgattaataaaccgtaaccggtggttaataaaccgtaaccgtaataacggtaaccgtggtcatgcctactccaaatctccgcttcactctctcttaccatggacgctctcattactcagttacaggagagtcctgatcaacaatgccactgaaccggaaatttgaatccggcgtgccatcttttgatctgcatgccactcttgtagtggataatacctatttacccttaatgaattatatcaattaattttaaaagaaaaatcaaaaacaaaatcgaaatcgaaataatcaatcccgacccaacccaattaattccgacccaattcatttaattcgagccgacatttaattccgacgagataggcgatttccgattaacttccgacatcggcgattttcgacattggctccgtcgagtctggggagcgtttgctaggtcagctaatccaattctccggccgtcgatttctccggtgctgcgtgctacgtgagtcgttactgttggatcgaattctttatcgatctttgttgcggctaatctggaaacgatccttctttagttcttccatctcctgtaagtattataattagtacaatgtaattgaattgaatcaatgtgtaagcagcatcaaaccatggacgaactgaaattgaatcagacactggtccatctcgtggttcaactggtactaatatattgtttatatttgtaggaggcgatgaagaagaggatccagacgaacctacactttgactatggagggtactatacagcagaccatgagtggagttgcaaaaattcaatatacggtatagtgtttaagacatcatctttggagagaataacatatgcggatttaatagataagatctgtagaaagattgctctaggtgttgagagaaggaatctgaaattgagttacaagatatctaaagcatgtagagagtcttatattgtagataatgaggatgtgttgatatatttaacgtcattggataaagagggatttagacctgttttgcatgtagagttatgcagtgatttggaaagtaataatagccaagttccaatagtagagcgaagaagttcatgcggtgtgaattttggggaattggctgccaagcttgtaatggttgcggatgcaaatacaggaattctgagtactaatgaacctattattgaactagaggaacaacgtgagacagttagtgaacctatgatgctagagaatggagtttctaaaactgttattgaaccgttgatgatagagtgtggggttaatgaagattctgataatgattatgttagggaagaatatgttcatcttgcacgtccggtacaagaaagtgtggctgccgttgtcaaagaatgggaagatggtattggtgatttagtaggtcaagaatttcgttcaaaggaggcagtatgggatttgattaatagagcttcgaaagaggaagtgtttggtgtgaaaactattaaatctgacacgggccgtcttatgttagaatgcagtcaagcatctaagggttgtgattggtatttaagagttacaaaaacttctgagacagatttttggtgtgtgaagaaacacacaaatacataaatgctctcggtgtccggaggcaactagatatgaaaaacaaaaaggcacaccgcgattagtagcagatgtgttgcatgaggactatccgggtcttcttaatactccgaaacctaaacaaataatgagtattgttaaaggaagacttggtttggattgttcatactccacagctttaagaggaaaaaaaaacatgttagtgatgtgcgtgggagccctgaaactagctacaagttattgtttgcttatctgcacattttaagttcctattcatcgctttgggcgcaagcattgaagggtttaaggcaatgaggaaagttatagtgatcgatgcaacttttctgaaaaccatatatggagggatgttagttatagcaacagctcaggatcctagtcatcatcattaccccattgcgtttggtgtaattgatagcgagaatcatgctagttggaactggtttttcagaaagttgaattccattataccggatgacccggaattggttttcataagcgacagacatggaagcatcatcaagggagtcgcggatgtgttcccaaaggcatcacatggacattgtgtatggcatttgtctcaaaacattaagaaaatgctggcaggtgacaaagaagcaggtatggccaaatttatggaattagctcatatttatactgcgactgagttcaacattaggtatgcataatttaggagaaagcatcctaaagtagccacctatctggatcgggcaattgggattgagaaatgggctaggtgctattttcagggagacaagtacaacatagatactagcaactccgcagagtcaatgaacgctgtgttttcagaagtaaggaagtaccatctgttaccgatgatagatgcgattttggagaagttttctgagtggttcaacacacatcgcaaagattccgcgtctgcatcgaacacaaggcaagtggtgcctgttgtggagaatatattacacacgcgctgtccaattggtgcaaagctaaatgcaactgaactaaacagcttccgacaagaatacagcgtaattggaaatgatggtttttcttatttggtggacttggaaaggaatacttgttcttgcagagaatttgatatagataagtacccgtgcgtccatgctatagctgcagccataaagcgatctaagatggattggaatagccgttcaatcttgaatgtaagtatctatggtctttgctcgaagtattacttgatcgagacgtgggcattggcatattacataacgatttatgtggtgccgcatcaggctcactggttctttcctcctgattatgtggagaaggtcgcaaaaccgccagattacactccaaaaaaaggaaggaatcaagaaacccggttttcatccagaggtgagaagcgccgaaagaagactaataacaaagctactcctggcatcaacttggagaggtggttgcagcctgaaaccaatgatgattgacgtcaactcgtcaactagtacaagaagttcaactacgataaagtctttgtgtgtaaatttgtgtttctcggaattgtcaaatattgttcgacaggttcaattaagaacaatcctttgtttttaaatttgtgttttcggaattttgaagcatagttaagttttttagttcaacagaattgccaaacatagttcaacaggttcaactatgaaccagtcgttgtttggcaaacctagtacaacaggttcatttgggtcaactataaatacgggtggcatcccagtcaacgcgtcagttgaaataccaatcgtcgcgtcggttgacaggtggcactgcgagtaccaatcgtcacgtcggttggaatattatttaagacaggattacaatcgattttacaccattcatatttcatcctatccaaaaaaagagcccaccccactaataaaggaagctgtcgtttgttaacatggatggatatcattctgtttccgaactttgtcagactatcagtggatggactatttgcgttttcgttgtgaatgtgttcaagaagtttgtggcaccggatgagttcgaactgggcgtcatattggcagatcaaacggttatatattgcgaatatgtttaattttgtttctttcacataacttgcatgtatatagttaaaattatttggtgtagggtccccgttcccgaatcaaggctaccattcctcgtcgccttgcgtcattttactttgatcgaatacgagaatatgagtatgagtgaataattatcactaatttctcggtccgaaatgacgctgagtctgtgagagcaacatcccatgactaccagatatggtttatggaatagactattgttactaaagctttgaaaacggatgcactctcgttttggaattttactcctttcgacaacatcatagagaagacggttaacaagaatgtgttggtcggtgagttattttgacaattttatagtattttctttgagaaattgtacgaatacttacttctattattatacacaagatgtggtaggtgccattatttggcagagccgagtgaccgaaggcatcgacggtgtgaagttttctttcaagatattgaattagcagtaagttcaaatggttacttttttgggattagttcaaatggttcaaatgatatagtttaaacggttcacctatttttagttcacatggtgcacctattctagttcaaatggttcaaatgttatagttcacatggtgcacctactctagttcaaatggttcaaatgctatagttcacatggtgcacctactctagttcaaatgtttcaaatgctatagttcacatggtgcacctactctagttcaaatggttcaaatggttatagttcaaatggttcacttggtctattctgatggttcaagtgctatagttcaaatggttcagcatacctggttcagatggtcgtgttcacaatttctgatcaagtaaataatttctatgaactgcagcaataaagttctctattgtgaagcacacaatcaacaagctttggactttcaagctcactttcggagtctttgtactccgggaattgtggttgtactcgtttgctggcgtgtgagcggtcattctaaaccgaagcttgtgagtcatggccccgtgtcgaaggtgtttggtaatctggaaattccggaagttgataaaatttataatgtagtattttagttgttgggtactttgtattattcgtataaacgaaggaatttgtagtttttgggtactttgtattattcgtataaacgaaggaatttgtagtttttgggtactttgtattagtttttgggtactttattattttaactaataaaacgttgttctatgtttcttttgtaattcccgaaatctgtaagcctagtacaacaggttcagcccgttcaactataatcacttagtaaaatgtgtttaacgattttataatatgtagaaacgtttgaagtttactactagctcaacaaaaaatctactattactattaaagtgtcattgataaatatttttttataaaaattgaaatcgtggtatgtgttcagataaacaacctcttatatgataaggagtagttactatgagatcacctcaaatgaagtaaattacgtgaatatggtcgtatatcaaatgtgattctgccaaaactttcaatatgcaaaataaatcacagttaggttgggttcgacatagttatcaagtatgtacattaaagttcagctgacatatatgaaaacagtgaaaagtacatctatgtgtatgatagttcagttgtacaactatgtgtaaaattctaactgatgaacttgataattccagctggcataccgcataattccagctggcatactatatatcaactcaaggaataaatggaataaatgtctggatttatcaactcaagttaaattttggtggatccatatgtttaaagttttttttttttttaatggtagggttttgaggattttcatctatatttaatcatttacttgtgtgaaaaatcgaaaattcgagaaaaccctctgctgaagaagacggcggcgattctttagcggcgtcaagtattttccggcgacgagatttttccggcaaacgacgtcatttcttcacaaggttagatcttttctattaaagatatagggtttatgtggtgtattttagttcagatctagggtttataatagtcaagatctagggtttattttagtcaagatctagggtttattttagtcaatatctagggttaagtcaagtatttgatagtttaatattttgtatttgacagacatgcctatctcttttaacggaagctccgactcctctcctagtgagaaatctgacggtttcgactactacaatgcaatacgggacgggaattggggcattccgactaagtgctactgtggaagagacgttgaaaagggtaatgtggttggtggcaatctccacgggaaaacaagattccgatgtccactaaatctgactgaggtggatggagaacacttgcataagtggtgggaggaagccattgaagaggagttttcgaagtactgtagtcggaaggacaagcgagaagaaggacctcctgcttggcaagttccgatgttcgagcccatccacgagaagatacgcattatgaatgaccggatcactgatcttgagacccaattattcaaggaactacgatcaatgaggagtgctattagtatcctccgagctagaggagggcgtggttctcgttgaaccatgtatgaaccatgtgaaccacgttgttttcattatgcaagtatttacttttgaaccatgtgaagcactttgttttaattaatgtatgaaccttgtgaaccactttgttttaaatatgcaagtatttatgatttattacgatgtgcaaccaaaatatacagttgaacagggtaatgtgacgaaagatgaaccatttgaactaaactgtttcgaaccagatgaactatctctagttcagtcgaaccaatgaaataacattacaaagtcacaaatcaaaagcattataaaatcagggaataataaggtcacaaatccgacattacaaagtcattacaagatattaaagatctaatacaacattacaaattcctgtttctttttattaccaaacattacgtaaacaatggcaatggtgatcaagcaaagccacacaaaacacattgttaagcaaactttccacttgcggaatttctttttgcccaattctgcttcttctttcagttcttgtaacatcacatgtagctcttttgcctcagatttgattttgttaagctcatttgcaatgattccaaatttttctaaagcatcaacgacctcttcttgcacaacatcctcaacccacttaaacaaatcaccctattgcacaacccacaaaccaaatccgacaagtttagcaactacataaatacacaatataaacaccaactctacttacatctcttttgtttgtccacgttttcggatctcttttggttttacaccggaaaaaggtcttccgggattgtcttgactcttggatgtgaagatcgtcacatctgctccacacgcacaattcaccggaaaaccacgggctccgtcgaccccagatgacactgacactgaacttgaactcatcggagtagttagagaaggcactcacaaaaccctaaatcaattttggaattcgaatgtttcgatttagggattgattgaaatcgtttttgccttttcgaattttgaattatgaattttgcataaagcggactctattttttgaaatttattggattttgttttttgtaatttataagcccattaaaatggcaaaaggcccaaaaggaatacttattttagggatgctaaaacccctagtaaaaaaaaggcccaagcccagcccattttcttaatcgttcggcgtgaaagttcagatgggacagccgaagagtcacgtctattcaatttactcgtctgcttttaattttacacgaaaccaaagaattcaagaaattgaaactcttcaccggtgaagttcatcatggagagtcctgatcatcgacggagcattcagagggtaagaacgtaggcgccttcctctccggcgtctccgactccaacatcaccggattgttcttctccaccaccacctgagtggttagttgacatcgggtttatccgccgacatttgggggttccgcttcaccgtgtaatcccccctggagaagtggatgaggtctcctttaccaggagatatggggccggattttgttccagccccaagagattttgtccccggtcaagttattcatcccagaaagttttttggtcaaacggatctatccaatgagatgcatgacacatgtctaaggttcattcaaaaggtaaatgtaagaatagtgtttcgttgttgctcgtttggttaggtttagggtttaatcaaatttcaggtttagggtttagttgtgttgattgttggttatattaggtgaatcatatagtggtcgtatagttgtattgatggatattttgcgagaaattaacatttctattgttggacaggtggataatcaacaccaagcttatagaaggcgtcaccgccaactactcattaaattgtaagacctggagagaggtatgaggcggttggaggctcatccgaaagactgggtgagatacggtttcgacaaagttgctgacattccactgccactaaggaaatggtgtgttgagcacgatggatcgtcaccgaattggtcgtttttcacggagccagatcccattgaggaggacgatgaaccagatgacgcgacctcctcctacatgagagtggatgagcctccacgcgagtatcctcctgactctctctttcaataaacattatgcctttgttttgcttaagtttgtaagataaatctaaatctaaattgtggttttaaatctttattttgctaactatctatgttttgaatacaatgtatgaatctaaatgtttgaatataactatctgtgttttgaaagtaaattttgctaacaattatataatcagtcgaacggatgtttggtcgaaccatttggacttcgtagtcgagccatttggactttagtcgaactatctgaactatttgaactaatcagtcaaactatctgaactatttgaactaatcagtcgaaccaaattgaaccatttgaactaattagtcgaaccggatgaactatataggtcgaaccgtttgaactaatcagtcgaacacatttgaaccatttgaactacttagtcgaaccggataatcctagtgttgaactatctgaactatttgaactaatcagtcgagccggatgaactatataggtcaaaccgtttgaactaaccagtcgaacacatttgaaccatttgaactaatcagtcgaaccaaattgaacacatttgaactaatcagtcgaaccggatgaactatataggtcgaaccgtttgaactaatcagtcgaacacatttgaaccatttgaactaatcagtcgaaccaaattgaacacatttgaactaataagtcgaaccggatgaactatataggtcgaaccgtttgaactaatcagtcgaacacatttgaaccatttgaactaatcagtcgaaccaaattgaaccatttgaactaataagtcgaaccgactaatcctagtgttgaactatctgaactatttgaactactcagtcgaaccaaaataaacagttgaacctaaaagaccaattacaagccaaatgtttaaaaattcacgaaagtaaacatcattacaatgcaaatcaagccaaacgtttttaaataaaccaattgttccacaactaccagtaacaggatcaatctgcctttcgcattttcttacgcttcttatcatccgccacaaacggtgatgtaataaggcgggatgctccccttgtttgcttctttccggtttctattacaggtggcacctcctgcttcttcttgcccccgccattcttcttcgcttttcctttcacctctttctccgtcgtgtttgtctccttattacctgcacacattttaaaacaaaacctaagtcatatattcacatttttatacccaactgacattaattattatacttactgttttctgcaacctctggagaacgttcactgatcactatatcccgttgttgctcgtttccggtggtcacataaccatctggcgaagcaaataacacgtcatcgtctgttgcatgcccatcttgacttgcctcctctgtttgcttcccatgttccctttccttcagatctgccacaaataactcaatagactgcactctcacatcaatggcatcaatcttattttttgtttcatcaaagcctttggtcatcatctgcgtcactgaggttatagatgccacaactgtatctaaatcagggaatcgaggagggacagcagtctcggggacctcattctcaatctcatggacttcctcatccgaaatctcatttacaatacatcgagaagaaatgtccatctcacacattcctttccaccatatcatgttcttctctactaatagtcgctctctccaactgtcaataacaatatctattggaccgcagtcatcatcaacatcatcgtctaagagatctttcaacagatatttctcatgataggcaggtaccaaaatgcttggaaaatcctgttaaaagaaattcatttagcaatcaatcaatcaatctcatgatagactagacacacaatcaagtaaatacagaaactctaaccttagtattcccaagctctttatatataacttccaacgggacacctttcatgctacattctttaaacttatgcttgcacatccttggacagtcactcaaagcggagcgtacagggactctaaatttcagtccaagctgtggaatagcctcataagccagaatctacaaataacaaaacaatgttaatatcataaaacatgtacattacaccttatactcatataataatcataaattacttacctcaagaggcacaatgaatccactgaagcaaggttgagcttttggtttcacgaaaccattcatgttcttcatcattttccttattcctgccatacattccaaaaagatgtaacggccccacggaaacgtctcgcacgcattcaaatcgccaacaatccttaacagaaactcttcaatgtttccatcattctttgcaccagcttttactaccttgaccaagaagtacaacagcactaacttcaacctatttgaaccatgcttcatcttcgagcacttagcaagaacatctacaacctttaccccagattcttttttaaatatcctcttcacaaagttaatattccccattgtattcatttcttttgggtaactgtggcaatcaaacccacttaacaacgcatgctctttaatggaatacctaataggtactccatttaccacaaaccaagcctcctcgagcaaatctgtcttcactgtgcgcagcataagcacccacatgccttgcgtctggtggttaggctcctgaggcatgtggaatatatgcttgaactgatcgtgtcttttgaaccatacagcttcttctttaaacttcctctctatcagttcaactgtctgcgtgacctggcacctactgcttatcttgcacactttgccgtattctgaaaaaggaaaatgcattgtctgtggcggcagtggctgagaatctaaatcatcatcctccaaaccatcattgccagcctcatcttcctctgtctctttaacagaaacctcatcatcctcggcctcataagtatcctgcaaattcaataaacattaaccaattgaagaattcatatgtaccaaactaacaattcaaatgtaccaattgaactagttccatcaaattacttaaatcaaacatgtgtcacagatgaactagttgaacatttctaactaatacgagaactaatactcaaacaaaacaaatgtgtgtcatagagattcaattgtatatacctgacgattaacgttctctaccccttcttttggaattgtattcaccatttcctcctcctccaactcctccccattcccgtctttcgcttcttcgaattgttgaatgacagcgtcaattagaggtttcaaagttgtccctgtctgatcctcttcaatttcggcggttcccttaggagaagcctcatcaccaacacgcggttcctccatagccttttcaatttcagcggttcctttaggagaagcctcatcaccatcacgcggttcctccaaagccttttcaatttcagcggtttcttttgtagtatcattcgccgcaacatctcgtgctgctggttctgtcagacctgctggtttggtcggaaccaagtcggcggcatctccgtcgttctcaatttctgaagtaacttgttctgatgtcgaaacttcaccggacgacgacttctccgtcgaatcatatacagggccagcaataccgtctctaacacgagccatcaaactattagacgaatcaagaattcgtcggaaaatcgcgaaaggcgagaaattatgaatttgattttggaaaatttgaattgaataaatggcagaaacggtttgattttaaaaattagggatttcgcttaagtttggaatgggttttgggtcgttgggcatggatcttaattggatcggatactttgttgggtcgtctgggtttttggtcttttgccaattatttgaattttctctcatttatttttaattcgataaaaaatgggaattagaagagtggcattcctggttactttttcgcagatagtggcattcctgccatttattcgttcaattccgtgattacaccatttctctctaccaacaggtttcaattctacaaatcttcaaacccaattcattcaaacgtctttctttagctaatatagatcagcgatactagatttactcagattcatgattaaagtgaagaaagtgtgaatctttatgtgtgaaattgttgtggttcttacaagttatgatttctagggatttgaattgtgtaaaggtttgaacttcagattcatgtgtttgttttagtctgttagatcattgttacaagttatcatttttagggatttgaattgtgtaaaggtttgaactttagattcatgtgtttgttttagtcgtttagatcattagtttggtttttgtttttgtgaaggggtttttggatgatcagtttactgaattgaagaagcttcaagatgatggaagtcctgattttgtagctgaggttctgtctcttttctttgaagattgtgttaagcttatcagtaacatggctcgagctttgtaatttcgatctttctcttatctcactcataatttttgttagatcatcattgctttgtgttgtcttaaaacttcttaaaactgtgattgtgtctcaatcacaaagtctggctagaatcatcattgcttgtgtatataactcagggataagtcgacgggaactgtagattttggtcaggtaggtgcgagtgtgcattaattgaagggtagtagctcaaggtatgttttgtgtctcgcttatatcctaataacaatcaagaagtatactctgtagtagcagaagttctgtgttgttgatagatgaagctcttctcttgtactcttgtttttgatagatgaagctcttctcttgtactcttgttttcgatacagtgttggtgcgaagagggtcaaagctttgtgtgttagcttcaaggaatattgcgaagctcagaattacgaagggtaagcttgttcaacaccgcttaaggactcatcggttgagatgtttgcagcaagtggatattgagtataagaccttgacgacaaagcttcaagatatgttcaatgtgagtagtgatgacatagaatccaatttttggttcattttatgaatcattttgttgactaatgaacaaatttattgccattgttgttgttattgcagcttgagaaacaaatcattcaagctggtggtagagttcctcaagtggatattaactaaagagagactaatccataagaaacaagatgatgacttcaaatttggattgttcagtttctccttttttaaatttattttggattttggtgttttgcttaaaaactcaatagaatgtgtggaaaaaaagagacaagtgattgttgttgataaattagtagtgtgtattggttctttgatcttattcgagaaaatttaacatctttggaccaaattaatgtgattgatgatatattggttttgcttctggttttagtttgagtaagatatagcaattaccaagtgagtcttttttggctagtggtgcttctaggactctccaaaggttgtggtttttaagatccttagttcgattctctcttggaataggtaggtatgtccatttttttggatcgcaaatccgtcctgactcgtatccgtcccgaatttttcatcccattcaaatgattatttgtttgggacaattaaatatgttctagcggatacatgaacggattagataagagacaaggtatccgaattatctttaaaattttcaaaatatttgtaacaattttaaaattattcaaaagtttcccaaatttgtccatgatttatcatagttttccgaaattatccatttgaaccttactcaaattagtgaaagtttatgtgaagaaaacttaaaagtaacggttgcttgaaaaagaaacaagcacaaagaaatttgatcaccgagttcacgacttagccgctatgttccggggaagatttcttgctccccactttcactatgagaatgaggttactgacaccacttaaagtgtgatgttgtcttttggtttcagatacaagcgatagaagaaccaagatcaaagacacaaagatgataaagaacaacttgctcaagaagctcgcgtttctctcactcttgttctatatacctaaatttctcgaacctatattgttatctgaatttttcgtcccgtattttatgaagaatattttggaaaaatatgattgattatccaaattagctgctctaattacatgttacttcctatctcgatatccaaaatagacaccctagaaaaaatggtgattcattcacgataaatcacaaacctgattctaatcaatgtagattagaagtccaaaggatactctccaaaaaaaaattaaaaaaaaaatagtgattagagggagcacaaagataaatgtaaacgcgagtgtagaagataactatctctttacaaatagtctttataccttccgcaacaagtaattgttctcatcagtctctctatgagtaaaaagctaagcgaaagcgagactccacactctcagcgattcaggcgataatacctaaactcaagtaagggtttttactctggtaagctaatcaacgctctcatctttaacaaattgcgacctttatatttctctcttcttatgattcgtcctctatgttctcaaaatagcttagaactttttacaaatttcagactttcttgtaatgattcttatgggtttaaacgtatttgatgatgaataggatttgctaaggatttggggatctttgttcggtttcaatgtcaataaaagaaccatattttatgactgagattgaggatcatgagatgaatgaagctgcgatgagtttggttatgttttctaaacaagtttatgactttgatttgactcatggtaatgatgatgattccatggatttagatcagcttaaagattgtgttgagtcgatgctagacttcagggaaatggtttctaactcgggtatggaaaagtctactacttgcagtgatgttgttgctctgagaagtaaattgcagagtaagtcaagtcatagatgtcaaatatgtggcaagagttttgagtgttatcaagctttaggtggtcaccgaagacttcatagaccgattaaagggaaattagcgcgtaaaagggagtattataaagatgataattcactgtttgattcatcaggaccatcaagagtggaggagaagatcttagattgtgttgagttgaaacaagacttcggcgaactgcttcctttgaatagtaagtttcagaaaagacctgtgagtagctgcagttatagatgcaaaatatgcggcaagagttttgggtgctttcaagctctaggtggtcactaaagacttcacagaccgattacaggggaattagcgcgtactgaaaatgataattcactgtctcactcatccgaagctaagaacattatgtcagaactatcaaaacttgaagtctctcaggaggataagatttaaccttgtgttgagtcgaaacaagactttagcgaactgctttctcactcgggttttgacgagtctagtagttgcagtgaattaccttctactctgataagtaaattgcagcaaaaaactcagagcatatcaagctgtgattgcaaaatatgtgggaagagttttgtgtgttctcaagctctaggtggccaccaaagacttcacagaccgattaaagggaaactagcgcgtaaaaggaagtacagtgaagatgataatacactagttgactcatcagaaactagacatgggtgaactactttctctgaatagtaagtcacagaaaacacctgagtgtagctgcagctatgaatgcaaaatatgtggcaagagttttgagtcttttcaagctttaggtggccatacaacacttcacagatcgattaaagggcaattagtgcgtactaaagataataattcacagtctcactcattagaagctaagaagattgtttcacaaccctcaagctttgaagtctctcaggagaagatcttacattgtgttgaatcaaaacaagacttcagtgaactgctttctcacttggctttttaacaagtcaagtaattgcagtaaaaccaggtttttttcattaccttcacaaccctcaagctttgaagtctctcaggagaagctcttacattgtgttgaatcaaaacaagacttcagtgaactgctttttcacttgggtttcgacaagtctagtaattgcagtaaaaccaggttcattcctttaccttcttccctgcaaagtaagtcacactccagcatatcgatcaaagagcaattagcgcgtacaaatgagaaaactgaagatgggttattcactgtttggcattattgactactcagaagctagcaaaattgtttcagtaccatcatgctttgaagtctcttatgaggagaagatcttacattgtgttgagtcgaaacaagacttcagtgaagtgttttcttactcgggtttcgattagtctagtagttgaacaatgaggagtatgtttggagattgaatctttagtttgttaaactttgttctcatctttacataaatagaagaaagaaacgagctttgcttggtttaaataccattttgtttggttaactcaagtttcagatacaaaatcaatccaaagtgaaattgattacttatcttaaccgaatcttttgaatccaacccaaactgaattaataaattataaaataacccaaattccaaaaaaaaattatcctgaaatgaacggaatccaaactaatggaaaaccaaattaaactaactaaaattcactaaaaatattaatattttattaaatgtatacaaatatatatttaaatatagagtaatattagtagataaccaaataaaacatacaaattaagaaactagcagagaaaaagttttttgttacaaaataaccatggacccacgttgtcggaagaaaggaaataacaaagctacccttcatttgttgtaagatgaacagtaaacgaaacacatccgtgtaatttttcaaaatagcatgtaacattaaaatttcacatgttatatttagtttaaaaacatgctatttaaaaaaacgttatgaatttttaagaaaaaacattattatgaaattcttttacataaacagaatctaaaaaaaaaaatatatgtgattttaataaaaaccatgtattactaaaaaataagaatatatttttaaagaaatcatgtgtgatcttaataaaaaacgtgtattactacaaaatatcatgataaaaagagatattaaactgaatagaatgttttttccaaaaaataccatgtgctttttataaatactatgtaataagagaaaataacaagataaaaagaggatattatgttatcgcatgtatttcagaaaaataacatgttacaaaggacatttacgtaattacacgtgttctccaacatgtttccgacaagatattatgactcaaggttagtttgtacattcttttcaaatctatagtcatttattataaatactcttaaatatattaaaagtctataattttaactaaattagttaattattattttaataatttatttgtcaaataccaaattaaaccgaacctaaaatataatttgatcccaaatgaaatttattttttagaaccttaaatataaaaaccacgaaaccaaaaaaaacaaaaacattgaaccgaaccgaaccgaaataaaagtattttctaaaatacaataaaaactctaaagtggaatagacataccaaaaccgaaccggttaaccgaatatccatcccaatttattccaattcatttgtttgcatctggttctgtttgagtaagatatagttagcaattagcgagcaccaagtttatggtacacgcgagtgtaggagaaaactatcccttggcatttcctcttgcaaatagactcattagcttccacaacaagtaactttttccattggtgtctgtgaatagcttatgatcgaaaacgagactacaagctctgagacaagttaaaaatatattctttaaggtcttaacctcagagattaggtcaaaatctgttctttctcgtcttgagtcttaaggatttcgctctggtaagcttatcaaagctctctgctttatgattttcccgtgaaaataaattgagaagctttcatttttaccatttttgttcttcaatttctcacatttttgttcttcaatttctctatacagcggtctatatctgtacagcggtctatatctgtacagtgatctacatccgtacaatgttctataatataaaatttaaaacattttaaacaaaatgcatatcaaatgatagagaaaaaaacatagatttttatttatatgatcaattttagaaaaataaaatttactaatgagcactttagttattaaacattgagggaatgtgtaataaagaaaaaaaagaaatttttaaaaaaaacttgacccactaaatatgccccacatgtctctctctctctaacccaaccaaaaccgactatattactaattgtgaatagtatatgtactacttctataattaaatttcagaaacgtactagtcttcaaacaaactctttttgtttttgggcacgtgttgaccagaagaagtttattgagaaagagactaaggaaaatggtgtcgaagtttcatcaactcctgaaaatgcgatgcttaagagaagtcaatggaaattagagttgttgaaacaaggtacattcacgtgccttgtttttcttcttaatgttcaactcatattcaatcaacttctgatacatatagattgaatttgtatttggtgtacttgtctcaaaccatttaacttttattgatttagttgttagaccagcacgcaaacaaaaactaaaagaattctcacatggttagggaaacaatacagatcccaatataatcggtttttctttttttttaaacgacttctttcattaattgagaccagtatgattacaatgtgaagctgttattatgaaatcaggaacataaaagtgaaagtgaaaggtgctgtttggtggcatgatatgtttagccagaagatccgctgggtgattatttgatcttggagtccattgaaactctgcgtcatcaaaatgttctcgccaatgtattgcgtctctgatccagttgcagtagctaaagttgatgtttttgttgttcatcagctcctccacctttttgttatctccttcaaagataactttccggtgtccttgactccagagatgttgcattgcaatgataagagcctgaagttcactttctagggcgcatgttgtcgtgatgcctattgcctgacctgctcctttgtagattccttctgcatcccttattatccatcctgctttagattgtctttattgatggttgaaagagccatcgtagttgcatttcacccatccataaggcggtcgtttccacacaatgttttgctatgctgttggtatctcttctcgacattgttgggggttggaggctgtgaaggtagtcagtagaagtgttccactcttcctcatcattcctagcaagttggagtgtggtctgccatgatatactcttttgttggaaaatcaattggttcctactcttccaaagtcgccagacaatccaaattgcaaggtgagagaggtgtggatgtcgtctagcaaaggtgggtgaaagaatgatgttcatttttgtgtttacagaagctccaggcatcgtgatggtattatgcggaaaaccggctgctctccagacctgttgtgcataaaaacaatcaaaaaataaatgttgtgtagtttcctcttcttggcagcatcgtttgcagacaggttggttccggatgtgtcgtctcttcagtgttttaaggctccagatagaagtttccacagaaagtatcgtaattttgggactgttttaagtttccaaatccgtgtctttaaatctaagttccccgtggtggttatacgtttgagtctctgtaaagttgatttgctaaccagtaagcagatttaacagagtaaagtccatccttagtataatgccatccaagcatgtcatgaggtgcatgggcgcttagtttcagggacagaattaagtttgcattatcttctgtaaccttctcgctgatgagatcctctttccacattgaacttgaatgcattcattctgacaacagttgattctcttcttgaccattctttacccgtggaggtcgtagagggtgaaccggtaaccaagggtctatccatgcactgatattggagccgttaccaattgcaaatcggagtccttgtttgattaaatcacggccctggagtagtgacttccaaacaaatgacgcctttcttttctgagtagcattgagaatatttgattcattgaaatatcttcttttcacaatccttcccatgagacactctggttttttaggatcctccaaatctgttttccaagtagagccaaattgaagttctcaaaatctttgaatcccattccaccttttttttcaacaaagacattcttttccatgaaaatcaatgcatcccttttttatcttcaccactactccaccaaaacttagcaagaataccatttatttcttcacaaatggattgtgaaaacttgaagatgttcatggagtaaactggtacggcaagagcaacaaccttgagaagcacctcttttcctcctgccgagaggaacttcttactccatccctgggtttttgaccgtacacgttctacaatatattgaaacatttcagcttttttcttctttatctcttctggaagtcctaaatatttgccttgacctccttcgttgtggatccccaagatacgtctcatccgagtctttacttgtggtttaactcggctaccaaaagaaattgatgatttccttaagttgacagcttgacctgaaaccttctcgtaaaggctgagtatctcgcgtatagtcttgcaggatttatcattcactagcatgaagaagagagagtcatcagcaaataggagatgggtgattgctggtccttggtcactgattctgatgccttggaggtgacgctttaaatctgcttgtttcatcatgtgggacaagacttccgcgaataaaatgaataaataaggtgacataggatctccctgacgaatacctctctctggtgtgattgatccttggggagagccattgatgaggaccgaaaagctgaccgaagaaacacatgtcattatccactggatccaacgatcatcaaatcccatgtactccattgttgtcttcaaaaaactccattctaatcggtcatacgccttggtgatgtctgtctttaaagccatataggattttgattggcgtttcctggccttaagcgcatggaagacttcatgggcaatgatattgttgtcagtaatcattctcccacggataaaagctgtctggttatcagagataacactagataagtgtttctttaatcggttcactaagatctttgaaatgatcttgtagctgacattgtagagggctattggcctaaactccatcatacttgttggtgcttccgtctttggtatgaggcagatgtttgtatggttgtgttgctgatttagaaaaccctctacaaagaatctctcaacttccttaataattgtagggttgatatcatcccagaactcgtgataaaacgctgctgaaaatccatcaggtcctggagctcaatgtggtccagtactaaaaacagctgtctttatttcctgaggagtaacatgtcttgtgaggtccatattcatctcctgtgtaacccacttcggaaagtcttagaaaatctgagaatgcagatcagtagtatctggcgtagaactaaacagttcttggaagtaagaaatggcaacatctgcaacttccttgtctcctcttctcgcagtaccatctttgtcttctatggaaacaagtttgttgcgatctcttcttgtctttgtcactgcatggaaatacttggtgtttcgatctccctcatgagtccatttatttctgctcttgtgcttccaaaaaatatcctcttcaatataagcttggttaaggtcctgtttcagcttttgtctctctgcaggagatgaagttccaaaggaaaaagctttatctagattataacgtataatcccctaagattagccaaggctctctccgtcaatttattccaatcctttctagcctctcccaaaggtcatttctgaaactaggatttggaggtccatacacaaaggaaaaatagaaactagtttcattagatttcacaaggcaatctacaagattaggggattgaaataaaacagagacttctagtgaatgcttccataagactactaaaccaccactaaggcctatgggctgaactgttacatgaaagagaaaacctaattcacaagcaacatcacgaacacgatcatcttgttgtttggtttctgaaaggcatatgatgtccgagagatagcagtgtgttatctccttgaggcgtcgaactgtgaggtcaatgcctaaacctcgacagttccagcaggttatcctcatggcggctgtggtggtttagggcccaccgcgcctctacactaggtgctcccactggagctgttgccttctccttgttccatgatcaccatctttgagcattcattttctttagattgttccagcgaatcctctctctttcttttgcctctctcagttgccattgcctcttgatcacattgagtttggggacatcacctcttcacgtgggtggatggatgcagagtatcttgcatagctttcatcaccgggaatgtctcctgtagcatttgcaaagattgatattgggttgaagagttcatttgtgtcactttctccctggtacatgctgtaaggttgatagtcttgaagatcatcatctgcattctccagcaagttttgttggggatctagggcatattatcgtctggagcctcaaccaccagagccatgttaggaccgccattctcttcaccctcttcaatctcacagatttctataccttggttttggattccagcattgggtatgtcatcatcatcgtcaccctcagagtcggaatcatgtccaccattggtgatcacacaagctccggagtcatgggttaacataccgcagacctcacaaaagcctctaaggcgcttatatcgaaatcggagcaaggtattcactccagcctggaactgaaaattgcgttggaaacgaaggatattctcaacattccagtttatctgcacccgaacaaatttaattcatgatgctgcctcagcatcataatcgatgtcatgaacctcaccgattgcgcctccgatctctccaattacctcaacactgaggaactgaaaaggaattccgcgaatttggacccaaaatgggattgtggtcagaggaggattcaccaatgggtccatcgttgaagcataagcattcggtcgttgaaagcccatggacccctctgaatcaccatgtcaagcgattcttccgatgggaaaatgaattgaaattggttgcctgggatgattatgacatggatcaagccggcttggccccaaactcgtggcattgaggccacaattgaacggaggttctgtctgcgggggataactggacagcccatgaggatgaaccggttctctgccgccggttgggccaccactgccgccgataaagtaactggagcattgtttgcgccgagattgatgtcttgtactgctcgccgcaaattgtctgccattttgtgaatgagtaagtaaaatctcaaggggtagaaagaagcgagagggatagattattcaggaggtataaaggcgaggaattttttgaaccgcaactcctgtaacatcacgatggaaagagaacatcatggagatatctaccggagagatgggccaaggaaattccataacaccggccaaattgctgaaaactgccaccactgtagtgggaagaagatggttaaaagaccgtaataaaatcgcccaaaggatcgccatttctaatcggttggtttttattctttgttatatatatatgtatatatattcttaaaagatttgttgtaaattactctgtagatctgtgatgaaagtggattacgagctttgtcgggaaagagtgacagaagtgatacactttcaacggtacgtcttcttttgttttgttttgtttttgttgatttgagatttttaattcgcataaaatctgtcaagtaggttagagaaaaattaattagataaaagactttttttgattagataaaaattcatgtctttcaaatgttaaattcattagtgattcacatatgggagaacaatctcaacgtaactttattaaccaatatataaaagtcaatacatatctatgcataaacgggattttcatacaaaatctaaaaaccttaaaaatatcttaaaacaatgaatgaaatttattccatgagcaatgaatgaagatggtccattggttgtgcatacatgatttagtttttcaggagccacatggattgtatgtcactatgtatagcactccacctctagacgcaaatgaaaggatttctcctatcatctcgtctactgcacgagtcacgagacattaaactatgacagttgaatcgaagaagatgaattttagaaagtgaacttccaaaaattttagaagagtactatacacatttaattcattatttctaggttcatgtccctaaatgcttaggattataaattttcaacaaccgattaggtggtgaaaaacatgctgatgaaatctaagaggatgagtaattctccattgtagtgaccaatgcataagtcaaatagtttgggtaatatttctctgagatcttacgatgccatatgcggtaatatatgatgtttcctggaacggaaaattctctttggtaccatatattgtgagtaaagtctcatgaacatcaatgaagatcattaatcattcggtggatatcgaatcaatcaacaacagaacgagaaagaaaatatagaatatatatgaccattagtatttacgatatactaagcttacattgcatcttataaggcaatgcaaaatcatcaggcatgttcaaagaaaatgaacaatgatatcttcacttcttgtgtgtatcatattttgtttaatggttacctctaagcatctttaacggaagactagtaagaggacaaaaacaatttagtttctaaaatcttcatagctttctctacgtttcagataatgttatgtaccttttttttttttacctttacaagcttctgagctaagagaggactacaacaaagtacatatacttttttgtattcctttgcgataatcaattgcttcttccaacacttgagtaagggagaaaatataaaaactaaaagtctattcagagttgcattaaaatgtagaacctgaattggaaaaagatagactcttttattttactcagcttgatgttgaaaaatgccacaagagaagcaatggaagtatccaccaatatcaacttggcttatcatccttgcgacctgatttatcactattgaaagcacaatctagatggaacgacaaaccaatcatcctttttcttcatacatgaattgtatgtgactcttgtggcttgtaatttcattctcaattgtgctttgaataataataagtaattaaaacagtaaataaatctacttaagttgaatttctacattttataatacattggtattttttttcttttttcttctctgatgttggaaaaagcaattgatgatagtaaatgtagtccactgagtccatatattatgtgaagactagcctagtaatgcatttctgattataattagtttttggttgttgctgaaatgattatcggttgtaggtcattctgttcatgtactagtggtcactgaaaaactaaaatagtcatccgactatgtccctaaagttttttgctaaaatttctggttttataatttttagattaatgttagaaaaagagataaaggtgccttgtatcgacatgaaatatccaatttgaacaaactcgatacaagaactagaataactatcaggaaagcgtgtcttgaaaccacattaagagcgagaaagcgggtctcgaaaccacaactcgagtgaatcttaaaaccttgatagatgcctacgggcgggtcaagtgttacggattccacggtttgattgttatgaactaagtctctgctagagtccctaaagtccaaaatttcgcattgtatatactatttatttagcttacattgcatcttagaaggttagctaaagaagcttggttgggaaatttggcccgaaagtgaagaggttaagtctttctagctaagcccaaagccatgtgtttttcaagctcaactaggatactagaagcggaaagatgttgcaagtgacattcatcaaatcatggagatgatgtagtcgtttaaaaagactacactatctcatgacatgaatctattgctttagccactccaaatccagagattggctacaagaaacacaacacaatgaaatctgagtgaactataaagctaaaagattcgtaatgtatacattcttttataccttgccgatagagtaagtcgttgaaaaagactacactatctcatgacattcattagatcatttggtttatcctaccacaacatcatttggtcaagatttgacattgctttaattaggaagtgtttgacgtgctcgatctgctcttctatgtcttcatcgtcatcacaaatttcttcaaacttaaatatcttaaggaccttcaacggacttgataatagagattaacgaactttgtgatgacaacgaagatacagaggatcaaatcaagtaggtaaaccactttctaaagacaatgccgaatcttgaacaactgatattgtggtacgatacaccaaattatttgatgataccattagaaattacttttactcacccacgattctgtatttggaaaagatgagacaattagatatgcaaaattaggctttgaatcttaaagtcattcctaaactcatgaaaggcctcctttagtctagatgacaaaattgtttttggaagaaacaaacggttttgcaaaacttgaaacatggaaaattaaacaaatgtgaaaatgaagcactaatttagtaaagtttttttattttagtgttcagaaaaaaatctatcttttaaaaattatttgatttagtgtcactaaacatataatttttaaaagttggatttccttctgaaaactaaaattaaaaattttactaaaatatgttctattatacatataagatataatatagcttctagctagatagatttttaatttttaaagttatcttaaacgtttgtgactttacagggtgatattttaacttttatatagtatgtgactgcataaattttattactagtaaagaatttagtatatgtgtacttgttggggtgtaatctatcaaaaatagtcagatgaaggtgataaataatttcgttacagaaaacagcataaatcactgataaaataaattgataagtatgaaccataaaccaaagtgatatatatatatatatatatatatatcaaaattatttaaaatttataaacaatttatagacacatatacaaacatgtgttcttacaatattgttatcttcttcttatataatgtattcaaaccattattatgtcaagtgccaaaattattttaaaacttttgtcacttatttattaatgaattcaaacagtttagtatttataaacacacctacctattatcactcttaaaattttcactgttttcaccacttttttttaacatttgactttattaatatggtgtcgttagtttagatagtcacaatgtaaggcattcgtgataatagaaggaacataaaagtgagactgaaaactagacagtaaccttcaaaaataaccttcgtgtatcctttactccaacagtgttgcattaccatgatcgaagcgcttgtagttagctttcgagagaccaagtgtcgttagctcaattggtaaaaatcctacgcgaagtttagaggtcgccggttcgagtgacgtttgggacgaaactaatattacatgctatggtttcgggcctagggaaattatgggttttggctcaaaaaaaaaaaaaaaaaaaaaaaaaattagctttcgagagcattcatagttactctgcatgcatgtgccttgacctgatacaagataagtaaccaaataatatttgataactcaacctgatttgactgtaatcttccattgacaaaggatcaatcatatatagttacactttgtctaatcctttggccgtcatctccaaaacgtatggcttattttgttgcttctttgatgattttatcacacagtcttagaccatataatttccatcagtttgattacgaggccgtggcagtcttggtggatgtgaaggcaaccagggatcggaccaagcgttgatcatcgagtcgtcgtctttgtaaatctcgaccttgtaacagtgatctccaagcgtatgacgtcttcttctctagggtagcatttaacacacaatctggattatgtagaacactacaaaatttattactctatttcacaactgaattgttttttggtatcacagttgattcatatattttcaaatagtttgttatacatagaaagatatcttttcaaactagaatagtcctattattcaaattaaatattatttatttaatttaaataattaaattaatatattaaatttgttgaaataaagagagttcagatagacttgataagattttagattatttgttgtccaaacacgttgtgacacctaccccctctgacaaaagaaaaagataattaaggtttacaaaccctttattttttatatatatatataatatatatatatatatatatataattgaagcatagcaagacaagaacacagccgcccaaagaaccaaaaacttctctgatccattgttgaagatgaagcagaatccaaaggcgaggagatatagctctcggtgtaatcggcagtgtgtcaacgttaggtctgcttttgtagcagcacatgtacgggaagaaggaatccatttcaggcaagcaatataaaatattcgatcaaatttcagatatacttgtcttaaactatttaacttttattgatttaggattaagaccaagcaaggaaagaaaaactgaaagaattctccaatggattacactgtcgatatggttagcgaaacgatacagatttagatctaatcagttggtttttattctcttttctatgtgtttttaattcttaatagatattttgttaattactgcgtagatctgtgatgaaagtagacagaaactacgagttttgtcggaaaaaaatgacagaaataatgcacggatgctttgtgtcaacggtacggtacgtcttgtcttcttttgtttttgttttttagtttttatttgagacttttaattagcataatatccttcaaattagttagatagaaatttgataagagactttttttctgtttatcttttgttgatctgagacttctattgattagatagaaatttatgtctttcaaatgttattttcatttctaacagtgattcgaatatgagaacaatctcaactttattatatatttgagtttgaacgcgcgcgcccaaatgtttttctttttagtgtgtaaaaattatgagttggttttatatatagaaggttttgtagttttttaaataaaaaaaacttaaccaacatatagttagtttaatgttgtaactctcatctcaattagtctactctatctatctattatgtctttttaaaaaaatctctactaaatgtttatactatgtaagcaaaacattgaaatcattagcttatcttaaatgtcttactcaaaaatgacgactacacttttaatcccccattcattttgatactattttcataattacatatatattttataattacatattgcaaatttacgtggatatgtattcaatattatttattttttttcttaagaaaataaaaggataagcctatttaagtttcacaactgaaaaatattaaaacacgcattaaaatctaattgattaattgaaagtttgaaacatgtctcgctttgtaaaatacagttttgtaatatgtcaagctctgttaagaatgtacaaactttatataaaaaattaataaacttttagttcttctcagaaggataaaactttcttattatttttaacatattaacaaaaagaattataattgaattaatgttaatagtgtaatatattaagattttctttatgggataaagatcttttatctttttctaatatagaaaaaatattccttttatgtacttatgtgtatatttctttttgataggtttaagagtttttctatgtttgtctttaaattacgactttagatttaacatgtgacgatatttggtgattatttggcacctgtcgcgatcacatgagttagcaactttaaaaatcaatggagtagataatcctcgcctcaataggcggatgtaaaaaatatacagaaattttcttataatatttgacttctaataccaatccacacttttttattttatctaaatatttttaaaccaaattttaatcttactcattacattttgcaatacaatttaactatttattttatgataacaaactatattttaattcgatatatttcatcttaatggataagagctaataaacaaaatctacatattccatcttattggtcaatttatttttgactatatttaaattttaaatagtaacccaggctttttcaatatttagtgttctaaatcttatctcaattttcctattatgtttaaatatccttcaataacgtaagttatttttgttgtttactaaacaactaatactatgtgacttccactttaaatattagtactatgtcctaaactttttactcaaacataattacacttagtactcatttatctttgacacaattgagacatctcaccattttatgtgttttgttgacatctatatattaatttatcataacaaaacaaaaggaaacggacaaaatgttaacaaaatacaccaaaaaaaacatttttgaataggttcctaattttttttaaaacccattttattaataatgtgatttatgtatataatttttggaaagtattataaaattttctaatttctattttaaatatattaacaaaattaaatttgatacatgtcgatatctcctcaaagtacttgactcgtgtcgtaatcacgtgagttagtaactttgaaaatcctacttttatataataagatattttaactcatcaatcaaaatttcatacaactttaggcctatacgccatatatataacaatgaaacttcaactaaaccaccgagttactacaatttgacatattagtaagcatcaatgacgagattttagtcagtcatgaatatgaagatggtccattgcttgtgcatgcatggttgagtgttttaaggagccacatggattgcatatcattgtgaattgtttagcaccagaactctaggagcaaaagacttctcctatcgtctacgagatgagacgtaaaaattttacgtctcaagacttaacacttaaactacttatccgatccaaaactagagtaactgaaacaccataagctacttaactagcatatcacatcatattagttgacttaagaaacaaattactccttggttgttttgttgatgagactagtggatgtgagggatcacacctcctccaacaattgttcctttgatgagtgtgtcaagctcctcatctcctctaaccgccaactgcaaatgccttggagttatcctcttcactttcaaatccttgttagtgttttcggccaactgaagaacctcagtagttaggcattcaaggattgaagtcgtgtagacaacatcagtcgcaccaacagtaccatgtgcagaaactctggtcttaagttgcttgtgaatacgagccactggaaactgaaagaaacaaagaaacaatatcagtataaaatttcatcaaattagactacaaaaaatgaaatttctttgtttatttcaatttctagtgggtcgtattcacatacaactcaagactagagtatctacaacatggtctacttggtgctattgttgttgactacacgccttcaatcctaaagtgcctaatttcataggttattgagttacttagaaacacaagcaatgataagaaaatgaagaggattactccaatgcattgatagttggtgatcgcaggagataaggatcttgatccattcatcaaaggaacaattggtggataaagagtagtctctcacatccacatgtctctcatcaacaaaaccacgaagaagtgttttgtttatttagtcaaatgatatgatgatgttattttctagttaagtagcttattgtgtttgtgtttttttttttctaatacaagatccaaaaaccctaaaaatatcctaaaacagaattactccatggaaaaggaatgtagtttcggtatgtgctactggaacttcaactaaaccagcgacccattacaatacaaagccattattgacactcatgtttcatgtattgtcattctggtgaaacatgaatgtttaagcattagttaagatattttagtcattcgtgaatatgaagatggtccattagttatgcgaatccatagtttattgtttcaaggagccacatagattgtaaagtcattgtgaactgttagcaccctacttttatgagcaaaagacttctcttatcataccacctctccctccaccacaatcatccgaacattttcaaaagcactcatcctcgtcgacacatcttttagtatattcgtgttgcactccatgaaacataaaatgagaccgtttcaaaaacatttaccgtgtaaaatcatgtcagttgttaatatcaagaatgtgtatgctactttaaggaagaggctttctagatttggaaaattcttgagtagatttggaagtgattcccttctatacatggcaaaatagttaattgcatcaagttgttgaatatcggtattgtttcacttcagtcattaagtacgtgaaataaaaaccaagttaactatatcatcactaactaattgtcaattgtaaactttaacaaaaaagatgtgactgaccttaaagtgtcacagagacaagtaaatgatcttaacattgcatattctcatgagaaaggttttcaaactattcatgtctttgggttcaaaataaattcttcttcacatgttacatgtatgaacatatcaagtgtcatttgaagtctgagactagcttcaacaagcgaatcaaaactcgcttgttgatacttatcagtcttaatatcgaagtattctaggttgaccatatttgagttatcaaatgacagtggcaattaggctaatgagaatgtgtcactgtcatttgataatccaaatatggtatacatagaatattttgatagtatgggtgatgagtatcaacaagcaagttttgattcgcttgttgaatttagtctcgaacttcgaacgacacatgatcatatcatacatgtaacatgttaagaacaacttactttgaaactcaaagacaaaaatattttgaaaaaccttctcatgggaatatggaatgttaatatcctttacttgtcttgtgacaatcttaaggtcggtcccatctttttgacaaaagttaacaactgaaaattatttagttatgatatagctaactcggttttaatttcaggtgtttaatgactgtagtgaaacaatatatgtattcaacaacctgatgttgttaactattgtatcgtgtgtagagtggaaatctaccatatctattcaagaattatccaatctagaaactctcgtctttaaagtagcatacacattattcagattaacaattgatatgcttttacacataaataaattttgaaatagtctatttttctgcataacgaatatacgtactaaacaatgtgcaacgaggataggtgtttatgcaaacgtgaggggagggggggggaaggaaatactgtttggtgaaatttcttatgatgatgaagacatagagaagcaggtgaaacactttctaaagacaaagtcgaatcttgaacaaaggatattgtgctatgatacaccaactgataagatgttactattagaagttacttttattcgcttatgaattttaaattcattcttaaactcatgaaaagccttttttagtctggatgacacaagtgtttttaggagaaacaaacgttttgtaaaacttcaaacgtggaaaatgaaagaaatgtggaaaatcatctcattttcagattaaatgacaaaagctttcatgtatgtgaagtcaagtaatcaagttgtgaatgtaaattaatgttaaagatcactacatatataaaacataaagctctaaagtggaaaactctagtatgaacttgttaaatattggataaaatggggataaccaattttgtcaaaatatgtgtggaagttgtgtaacaaaggtcatattaattaattgttgctatacaagatgaaaggtctctttgttttaaaatttgtgtatctattggaagtaatactgtttggtgaaatttcttatgatgacgaagacatagagaagcaggtgaaacactttctaaagacaaagtcgaatcttgaacaaaggatattgtgctatgatgcaccaactgataagatgttaccattagaagttacttttattcgcctatgaattttaaattcattcttaaactcatgaaaagccttttttagtctggatgacacaagtgtttttaggagaaacaaacgttttgtaaaacttcaaacgtggaaaatgaaacaaatgtggaaaatcatctcattttcagattaaatgacaaaagctttcatgtctgtgaagtcaagtaatcaagttgtgaatgtaaattagtgttacagatcactacatttataaaacataaagctctaaagtggaaaactctagtatgaacttgttaaatattgggtaaaatggggataaccaattttgtcaaaatgtgtgtggaagtggtgtaacaaaggtcatattaattaatttttgctatacaagatgaaaggtctctttgtgttaaaatttgtgtatctattggaagtaattttacaaagtcaatttatatttttctatttagaaatgacaatagattaagtgggagactgaaaggccacttaatgaaagaagtggaaaagtttgaaagtggtgaaacttagtttagtaaaataaatacaaaagtggaagagttacttaaaagaagtgcaaacccatattctaaaataacaaatatgaataaactactttgttatatgtttttttctaagcgtggctgaaactctcttaaacaaggttcgaaacttgctatccacgacacacaatctttttcaaatgacactaaattacatcaatgactatattttcaacactatatttgattttcgtgttgctattttttggtaatgctatatttattactcaacaaagataatatctacaaaagctctttgaactgaaaacacaaagacaaagtaagagcgaagaataaaccttgagtgtgctcgaaccaaaactgaagaatatcttgcagccagactcatcttggaatgaaacaaggtaaactcatgtttgtcgctctgaatggaaattgaatttaaagaaagaagcaagcttcacgtttttttttgggatcatgaaaagctttaggcgagatcttgtaattacgagagagggaagttgacaaagagcttgtggtgaaaaacgacttctgcctgaactgtttgataatccggctctgagatcagaggatgagagtaacgattgtatttattgccaccatgaactagaaaacctttgttgcatattggtgtttgtttttgtgagagaaactgttggatgacacatcactatactaagaaagtcttgttaaattcatcgaagatgtgaagagatgagcgtcattggtctcatgttgaagctgtttgatgggttgatctgaaacttgggttccatcgtcgaaaatgcagtagcattaactggagttacctctggttctattgttggggaggaatggccatgagagttctgctgcgattgacctgaagcaattttcagcttgttatatgtcacttgcttgatttgatgctgcgattagaggactgatgtcatgtttgggaggaagtttgatgcaactctgaatctagtagctcaggggaagaaggtttcaggtttcaaaaacagttttatgttttgatgttgattcttccttcttcgttttgtttggctacagaactctgattttgcttctaaaagatgttctggaaacttgaaagcaagatcattccaatgacatagagatcatcttctggttccttatggtatgataggaattcgtcctcaaaattggctgctcgcaggttatgttattctggatctgtcatgggaaattagccataagtttcaaaccataaacccaaatcgtgatccgtcttctcctgtagcttcgtatatctgatgttgggcttgcaagcaatatttcagaattatcttggttggtttgtattagtcaagtaacacacatggatcatgggcttagagttaacaagaagaagagaagttgatgagcccattaaccccttctagaagtgcgattagagccgttagaagggagaagagaggagagtcacgggtaggctaaggtttcatcttagccatggtcaagtcactatcactctagagaaaagtcgtctactctctcttcatgtctctttcattttgttttgtttgttgtaaagggaaccctagtgtctccctatataaaagtcttgttccctacattgtaaccaatctaatctaagtaatatcttcacttcctattcttggctcttctctcctctataaacttcatacttctccatacttctcatactcttttccgcatattctaacatggtatcagagcatgttcttcgattcttaacatgctaaatctcttctacttactctaatctacttactctctacattcttcttaaatctacactttcctcttcaagaaacactctattacccaacggttaaaagagtgtacacatcatggagaacccaaaaccggcgataacgtcggtggtcttgaaaggagagaactatctactatggatgaggacgacaaaaacggtgttatgtggccgagggctttggagccatgttgaaaccaaacatgttcagtttaaggctaccaaagaagacggcgacgaagggttcaagagggaagaagaagaagctgagatcgagaaagaagccaagtggtttcaagaagaccaaaacgttctcgctattcttcaacattctcttgagagctccattcttgaggcttactcttattgtgaaacggcacgcgagctatgggagacactcgagaacgtgtatgggaatgtgtcaaacttgactcgagtctttgaagtcaagaaggccattaacaaccttagccaagtagacttggagttcactaaacacttcggaaagtttaggtcactatgggctgaacttgagatgcttcgaccaagtaccgtggatccggccattcttaacgagagaaaggaacaagagaaagtattcggccttcttcttacactcaatcccgccttcaacgatctcatcaaacatcttcttcgagccgacaagcttccttcacttgaaaatgtttgttctcaagtacaaaaggaacaaggatctctcgggttgtttagtggtaagggcgaacttatcacggctcacaaagggatctacaaaggtgaagaaaggaaggtatgggtgtgtgatcattgcaagaagaagggacacatgaaagacaaatgttggattcttcatccccacctaaaaccggctaagttcaaagcaaacatatctcaagaagttgcaagtgaccaaggagaagtggtgaggaagtcagatttggagtctctcataagatccatcgcctctctaaaagaatctggtacctctttcttgacctatgaaccaaataaaatgctaaaggaatccggtacatctttctttacttccgaaccaagtaaaactcttgttatagattcgggcgcatctcaccatatgatcaacaatcctagtctaatcgataatataaaaccggcgttaggcaatgtagttatagcaaatggagataaagtaccggtaaaagaaataggagagttaaacttatttgataagaaatctaaagctctatatatgcctagctttacttcaaatcttttatcggttaagagagctactaatgatttgaattgctatacaatatttggtcctaatagtgtacattttcaggatattaagaccggaagggtacttggaaaggagatgctaaaggagatctttatgtgtttgagaaaaccccattgagtgattttacttcagtttcgcttaactcatgtttagctagtattcttaatgttgtgtggcatgctagattaggccaccctcatgctcgtgcatttgaattaatgttgccaaatgtttcttttgataactctacttgtgagtcttgtattcttggtaaacattgcaaatctatctttccaaagtctttgactatttatgagaattgttttgacttggttcactcggatgtttggacttctccttgcatgtctagggataataagaagtactttgtgacttttattgatgagaaatcgaaatatacatggatcacattgttaccatctaaagattgtgtgatggatgcctttataaatttccaaaactatgtcactaattacttcaatgctaaaattaaggtacttagatccgacaatggtggagagtatacaagtcacaaattcaaagagtaccttgcaaaacacggcatcattcatcaaacgagttgtccttacacacctcaacaaaatggagtggcggagaggaagaatcgacacctcatggaggtagaaaggtcaatgatgtttcatacgaatgtcaccaagaagttttggggagatgcggtgatgacggcttgttatcttatcaatagaacacccaccaaagttctacaagatgtttctacatttgaggtactaaacaaaacgaaaccttctcttgatcacttacgggttttcgggtgtgtttgttttgttttagtatccggtgatcaaagaaacaagttggatacaaagagcactagatgcatgttcattggatactctagaactcaaaagggttacaagtgctacgatcccattaatcaacgtatgtgtcttgggatgtgaagttctttgaagaaaaaggttattacgagaagaaagattggaatagcttggcagatctctctacaccctcaacggatcgtgctacaagtttacagtttcttcttgaccatcttggagttactccatcaagtgaaagagaaaccaagacaagagacttgatagaagaaccgattactattgatcaagaaaatgaacaagaggaggcctccaacctacaacaagatggagagattaatggaatccaaatacatgatgatatggatactcaaaatgaagatggaggtgttcaagagataaccgatcaccataccaccactattcagccggatcctactccacaagcttctccaactttaagacgaagtactcggattaagagaaaaatcttctcgcttgtattacaacaataaggcggtagctcaccctatacaagcagtgtgttctcttgccctcttaccacaagatcaccaagcttttataggaaagatagaagcaaactttgttctgcaaacctatgaagaagctaaggagagtgaagaatggataaatgcggtggcggatgaaaccggagctatgattcgtaatcatacttgggatgaagaagacttgcctccggggaagagagccgtgagctccaaatgggtcttcacgatcaagtacttgagtaatggtgagatagagagacataaagctcgcttggtagcatgcgggttcactcaaacttatggtcgtgactatactgaaacctttgcacccgtcgccaagcttcacacggtgagagttgttctctctcttgctactaatctctcgtgggacttatggcaaatggacgtcaagaacgcctttcttcaaggagagctagaagaagaagtgtatatgactccaccaccgggactagaagattccattgctccgggtaaagttttgcgacttcggaaggcaatttatggcttgaaacaatctcctagagcttggtaccataatttaagtaccacactaaagggaaaagggttcaagaaatccgaagccgatcacactctcttcacacttcaatccgatcaaggtattattgttgctctcatctatgttgataatattatcatctccggagacaacaaagaaggtatccatgacaccaaactctttcttaaatctacatttgatataaaagaccttggtgaactaaagtatttcttagggattgaagtatgtcgctctcccgagggcttatttctttcacaaagaaaatacactcttgatcttttgaatgagacaggaaaacttggttctaaaccggctaagacacctcttgttgatggctatacggtcaagcgaaccggggggggaagaagaagaagaatgcaccacttgatccgttagatgaaccatatgaagattttgctcaataccgaatactagttggtaagctcatttatttgaccattacacgacccgatctttgttttgcagtaaatcaagtgagtcaacacatgcattctcccaccaaatatcattggaacatgttggaaaggattctacgatacattaaagggagtccgggtcaagggatatggatggggaagaatgatagtacctagatagtcgggtattgtgatgcggattatggtggagacaccaccgataggaagtcaacaatgggctattgcacattcattggagaaaacttagtcacttggaagacaaagaagcaaaagatcgtttcttgctcaagcgcggaatcggagtaccgggcgatgaggaaactaacgaatgaactcacgtggctcaaggcacttctcaaggactttggaattgaatcatcaagcccgatcactatgcattgtgataatcaagcggcaatacacattgctaccaactcagttttccatgaaagaaccaaacatattgaggtggattgccacaaggtacgggagaagatagaagaaggaatgattctaccgtgttatacggacaccaaagacaacttggcggacatctttacaaagggggcaagtctcaaagtttgtgaacacatctacaacaaacttggacttgttgatcttacacgtccttgatgatcttccctaatccatggtcattacactctttttcccttaacatagttttctcccatgtggtttttctatgttaaggtttttaatgaggtaatgtatcatgggttccaagcttaacccattcatcataggctaagcttgagggggagtattagtcaagtaacacacatggatcatgggcttagagttaacaagaagaagagaagttgatgagcccattaaccccttctagaagtgcgattagagccgttagaagggagaagagaggagagtcacgggtaggctaaggtttcatcttagccatggtcaagtcactatcactctagagaaaagtcgtctactctctcttcatgtctctttcattttgttttgtttgttgtaaagggaaccctagtgtctccctatataaaagtcttgttccctacattgtaaccaatctaatctaagtaatatcttcacttcctattcttggctcttctctcctctataaacttcatacttctccatacttctcatactcttttccgcatattctaacagtttgctgcttcgtttgttctctgcatcgaaacagactcgatgaagctgctgtttggtgaagtgttttttgtctgacattgtcactttcgtttgacttggctatagaactatgttttgagaatttcaagagtttttggaatcttggaaatgagatctctccaagaatataaatatcttcttctggttcattgtggtttcataggaatctgctctcaaagttggctgtttgcacagagttttattccggatgtgtgttgacattttgccataacttttgaaccagctgcagatgcttcagaacaagagttttgtgttcgtggagaagcttcagtgcaacttgatgaagtctatactagctcaaagaagaaaaaacatggattagtggttgttcttaaacaatttctttggagttgaagtatgaacaacatgtcgaattttgttaagtaggattgtggctggttttgattcacggcgggtaatgaagctgtcaaggaagaggggagaagaaggttggactcttgtgtgcttatgactagctgaagaaaactgagatgtttcggaaaatactgcaactggagagtgattaagtcaagattatgaatatcaaagtcaaagacatgttgaagattcaaaattgagaggtttgaagtcttgatttttccgctgcaaattacaaggtacttgtgatattcatgtctgatgtttttaaggaagtgtctctatgagcataagaaacttagcatgttgtgatcaatctgaggtaacattccagagtggtgtaactccggttcagttctgtaaggttagctgaagtgacatctgcaaggagatgttggtcgggatcaatctgaggtaaaaatattcaaagttgagtaactccggttaagtattagcccaggaagctgaagtgtcttatgctacgtaaaggctgtgtcaagatgttgttgtggctaaaggatggttcacacaaaagtagaagattaatagaaggaagtggcacttgaagctgtttttagaacttgtgtgattgggagtgactgcatgatgaaacatgacattggaagtgacttaagatttctaaacgaattcattggtagacagtcctgtacgcgcaactgctgagaaaaagtcaagagggaaaagcaaaggagaattctacgtgatgattcactctagatgagaagtttgtcggcgtcagcctaaattttgaatacatcgtgttaagtttctgttgcaactacaaagattcagtgtaggttacattttccacttcaaaaaattactgtcatgtgcgtacggcaggctcagatcctgttcctattggcgacagcggtacctttttgaaaatggaacaactactaagcttgaggttatatggctcgtgacaaggaaacgttttttggattcacacaagagaatgaaagcgatctcctcacaagggtaaaagagaaaggcagcaagtatgacattaaagaaagttgttaaaacagaagaatgtcactggattagttggtgtaaaattatctagtaaggctctgtttaaacatgatggttggaattgtgtcaaggtggtttggtaccttgataaagtaccctttggttcaagtttactgcaaataattcaagaagcagtctgttcaaagagaaagactgaaggtatgtagttttgtgacttttcttgtgctataacagagttatttatgggagagagaaattgtttacaagacgaccaaacagaaattgtctgcaagcatgccaagtttttttttaaccaaggagaatgattcaaagagagtaataaccctcagttttagatggggaatattgcagatggcttgatttgtacaagagaagttattttagataacagttagcttggtgcttgagctaactaagaagcttagtgaagttatgattttgagaacaagctgcatttggagacagcgactaggtgtgttccagcttgcttgagtttgttacatgatcatatctcttggattaattctggaaaagaaggcttgcagtgtcagttatggttgtgggcgtagaaattttggttgtgcgttttggtaaagaatctgattctctgattaggattgatagaagaatttcatgataataagatcattttgatggttgtatcagcaaggaagtatctattcaagattgtgtgttcctaagaagagaaaagcaggtttgagttgaagcttattttctgcagactgtttaaacaagaaatcctggataacatgaaaggttttagatgcaagaaaacatgggcttatgttttcaagatggattcttctgacagtgtctatgtattccgagtagaacgctagcaagtagtcaagtagctatcacttatgtcggtcgctttgtgaagttagaggtgttttgtggtctttcacatatttttaagctccatcaaggggagatactgatggatactggttttgtatgagtgagatgtaaaactcagttcacaagcatccaagcagggataagaatgtgatgcaatggtgcaggggtagtgttttttgccgtgttgttgcatatatggacgtttcggttgatggagcttggttggtttactctaaactgatgcatatttggtttgagaattgatatctatgttggattattttattgggccaactcttgaagattatgtgacaaagacgtaaagatctgatgggcgttgttgtttttggttgtcataacgctgaagaaaaagacgtaaacacggttattcagattgtgaagtatcctctaacaggtatgattaaggtcattctggactaagtgttttaacagtgttttctcactcaagcagggggagattgagaaggttcagcgaacagattgtaagcacaatgatataggattcatggagagctttatatcttgattattgagtggtatgcgtgctttacatggagagcttgagttgtaaaactcagttaaaaacggagagattgaaagtgcagatattgttgggacagtattgaagtacaaccgatgagatcgagagtaagtcgttcgtgacgtaacgtagaagcaaaaaggccatgtggttcatgggcctttattcaagttaagcccaattgcttgtagagacttgaagcgtggcttaagtcgtctagggtttttggcacttgatatataaactaagagatagcaacatgaagagttgcacgtctagggtttattaagagatgcacacttgtgtgtggcgtcgtcccaccaaatacagatgatgatcttttggtggtattcctttggaatctgcagccgttagagaagacggtgatgcaccggctgccgggtggtagtcaagacatgtgtggcttgatactgtttccaaagtccatctagaaaagagtggtaggcaatagttatgctgtaatatcatatgcaattgtatttgcaatcttgttctaatggaattgtttctggactaggtcccggagatgtaggttgttaccgaaccccgttaacaaatctctgcgtgtctttactttatgcttcttacactcattacacgctaatatcgtacaaacacatagacctagcacacacatagtaactatacctccatccgccaatccttttccgccacgtcctccgatggtgaaggtgaaactccaccaccttcacccaccactcctctaccagcttcacccaacactcctccaccagcttcacccaccactcctcagccacagcctgagcctcttgttccttcccctgaagttccaccagagcccccaaccaatgaagacaacgaacgtacttctgtgatcttcactttccgtggtgaattcctcggtcgatgggagcaaaggtcagtgaaattccggatgaaccaagaatcgtattccccaaactcagaaccactgagtatcactttattagaaatctgattaagaagtttacaactaccttaattggttttacacaagatctaaactactttagcttgtcaccagagatttccctaaacacacaagagcagatcacaagaacacactctttgatctctctagaattccaatcagactaaaccttagtctctaataataaaaagcgttgcactagcttttcactcacaatcacggccaagtctaacaagaaccttagcacctctatttatactatcgaggtctttggtcttctaggttagccttcgagatcttggatcactccaaatcttcgcgtgaatatctcctctccaaactgaactcatcctgttgtgatctccacgtcattcgttcatttggcggcatatccacgtcagcatcaattacttgatcttcactttagtcttctgaaacagcttccagcttgttccagcaatcagcactccttctggtttgtcctgacagagggtgcactaacaatctccccctttttgatacaatttgtcaattcaagcaatcctgcaagaaacccctcaaagaaaactcacaagcacacatcaaggcatagagataataagcagcggaaataaacaatagagggtctcatcatagattgcataaacaagtttttaaggttcaaaatacatcatccagtacttagaaacaaaaacctactaaaaccaaaaggacatgattaacaaacacagcttaaaaactcctccttaatcctaaactcccccacaactagatctagctttcttcgttatcaacatctagagagtttacaaatgaattagagttctcagggactagttcataatctccccctgcttgcatgacataattgatcaaaaactctatctagacactctaccaattaaaccagacactgagtacaggacaaggacaccataccttccatacgtgtcgttattgtcgtcaacaaagtagagacatatctcaaatctacaggtaaggatgtgcgaaacacatactctagattaaacatctttcgcatacgccgggcattgctgcgtgttctcccatcgctagggtttcggcgtgagagctcaattttctgggttttctcacttgtttcattcgatagatccctttatgcaaaccatagaaactcaaaaccaaaaatcagtgctaaccggattttggtccggtcaaatctcataaaacacaataaccaccataaaacaaaatcgaacaacccaattagcttatagaattgaactaagtaccactgaaaattaactcatttttctgaagccatcttgatatacacagaacaagtccccattagtatcagcacagtaataaccatctctccctcatactgaggtccagaactgtcccagaggtgattgtacaatactaagctcattgtaacttgattcaaaaaaatttagaacataatctgctgacacaacacaaaagagactgttgattctccaagagtagtcttcacaacgtcatatctcagagtgttagcgagtccttttaacaaggagtgtgacagactgtgcagcaacattcaggctattgatgaattaccagtctgatcttttgtattcagaacttattgttgtttcttactgctcctttctacagagagacgagatgtcagcgagagaacttgtttttccaccccccttatttttttttatttttttatttctcttgtcttgttgcagagtgtaatgatgctctttattacttgttctctcaatatttttgtttgacatcccttctctccaaagtgtaggtgaacaagatttctcctttgttcccatcgggttagtgacaagatttctcctttgtcccccgtgtcttagataagctcatgcttcatcttatgaaatgaaatgcttcttttctgcccctttctgcatttcatcccttccttaatgctctacacactgtgtctgtcacacactttactgactttgcatctccgaaccatgtagggtagctctttctcttggtgaactttttacagcagaagatttgaaaaccggttatgacactttgtaaaatagatatgaaaacttgcttctcactgtacaaccaaccctgtttcagcataaacactcatcaagaagatagttagacttcaccaatacctagggactttagcaagttcacaaacatgttcaagtccaaaggcttagtgaaaatatcagcaagttgaatttcagtaggcacatgttctacggtaatttgtttttcttcaactaattctctaacaaaatgatgtcttatagctatgtgtttagtgattgagtgttgtaccggattcttagatatggcaatagcactttcattatcacatttaacaagtaaagggtcagaaaaagacataccgtaatccaaacccatgtgtttcatccaaagaattttagtactgcagctgcagaggttggtagtgctcataggagtttcaactggattgctggaacacatatcgaagcgtttcaccaggttctgagcataggtgctttgcgagatagcaatcccttcattaatctgattgatttgcaacccccgaaagtacttaagttcgcctaccatactcaacctgaactcagttgtcattgtcttcacaaacgctttgaccaacttgtcgaatgtgcctccaatcctcacataaacatgatttatcacataacatgctgtactgatagcctctgtccagaatttttcaggaactccatgtccatgaatcatggctctggccatctcttgaaaagtctgattctttctctcaacaacacctacaactctcttgtgttggactctaatctgtttaccttgattgtaggcatcatacacaattttctctatgtgtttcagctcttgtactcctctaaccatttctttgctcactatttctgacatgctcctcgcattcatgtgaccaagacgttgatgccataccactggatcctccttttcagctctaagacactctttaggttcttcccacatgtagcaattgttcccagttctaactccagtgagagtgttttggttcttctcgtttgtagcccagcattttacactattgaaactcacagtcagcccttcatcacatagctgactcacactaatcagatttgcagtaagcccttcgacaaagtacacatttgtaagctgaggcttttctgctttagtcaaatcaccttttcccttgatttttcttttatccccacctccaaaagtaactttactttccttgacagaggtgtaattttcaagattggattgacttcctaccatatgtctggatgctccactgtcaaaataccatggtttctttattccttcttcaatcgaggtgtatgctacatgacaatagagatcctcccttctgacatacatcttggaggttcttccttgatatggatatagttttccttgtctcttcagcttattcaacctagcagcatacctgtagcaatatctctgaatatgaccatgtcttccacagtagtaacattcgtaacctgtcacagttctccgggattgatagtgatcgtgattctggtacacgcgtcttgctggaacagcatcatagttgcttcgaaaacctgtttgactttttgttggagcagcagcttcgcttcgtacaaaattcgtctttgtacctgatccagcaccattgtatcctaaaccaaaatttgattttcccactcttccagcagcaagtatactatccaaatcttttgttccactgttcagcatgtggatgttcttgcgagtgtcactaagctcttgagaaagttctctgtttttctcttcagccacactgcatttctgaatcagctcagagttcttctgatttgcagcagttaactctcctttcagcttttctgttagttcttgaacttttagcttctcttccagccaggcaactttctctttactcagcatcaaccagctgtcatacagtttcctgaactcttcattgatgttaacgtccttttcgatgtcagaatcctcatcagctgagttgtcctcatcctcaccatctgcttcactatctgaactttcatctttttcttcaatgattcctacaaaagacacgaaaccttttatataatcttccgagtctccatcatttgagtcactttcactttcagaactgcaggatttatcaggcttagactttgatccaacacagtcgaacttagtgtgtccaagaccattacactcagagcacttgagatcttttctctttaaggagggacattcagctttaatatgtccgtatccttgacattcatgacattgaatctcatccctttttgaacttcggtctcgatatctatcagttccctgatttcttccgaatcctttcttctcaactctcctcattgctctactgaagtcttttgccatcatgctcattgtatccttcaattcctgtatctcattcttctttgccgatgctgctaaagcaagtcctttggagtaacctccctttccggaagtgatttctaattcatatgcttggagcattcccactacttcttcaaaatcgattgagtcagtgtccaacgacgttcccatggccgttctcttactttcaaaccttgatgggagacacctcaacagtttcttgaccagtttcttatctttgtatttctttcctagattgtgtgcttcactcgctatggcactgattttcccactgaactcctcaatgttctctgtttcttccatactgagattttcaaactgagatgctaacatgtcgattctggatcttttgacactacttgtcccttcatatgctttagcaagtttatcccatgcttctttagctgattcacagttttgaatccgcttgaattgattttgattcacgaagttgaatatcaaagacagtgcccttgaattagctttggcctttgcctcttctgcatcattccattgatctttagtttttagcacatcttctccatcttctcccttgatgaccggagccttccacccaatgctcgtagcaatccaagcttcctttcctagaccacgtatgagagctctcatcttcactttccagtgtccataatttcctttttccaacatgattgttttaccgaccgcaacgaactctttggggtagtccatcctctccgtaggatctgcacctgttgttaagtacaactttgttcagatgcccgctctgataccaaatgaaattccggatgaaccaagaatcgtattccccaaactcagaaccactgagtatcactttattagaaatctgattaagaagtttacaactaccttaattggttttacacaagatctaaactactttagcttgtcacctgagattttcctaaacacacaagagcagatcacaagaacacactctttgatctctctagaattccaatcagactaaaccttagtctctaataatgaaaagcgttgcactagcttttcactcacaatcacggccaagcctaacaagaaccttagcacctctatttatactatcgaggtctttggtcttctaggttagccttcgagatcttggatcactccaaatcttcgcgtgaatatctcctctccaaactgaactcatcctgttgtgatctccacgtcattcgttcatttggcggtatatccacgtgagcatcaattacttgatcttcactttagtcttctgaaacagcttccagcttgttccagcaatcagcactccttctggtttgtcctgacagagggtgcactaacagtcagtgccagagagggagtacttctcagatgatgacattattgatggagatgatgagggggtgataacaactgatgatgatgacagtgacactgatcgtcactgggaagattgggaagaatatcaactcattgaggacatgaagaaacagcaagtcaatgactcagacacaagttcatcgtccgatgaggatgatgttaaaagtggcaaagaaaagcttggagagcaagcaacaaggtcattgtcgacactaggagttctcggttcttaattatcttccttttttttcatcagtttaagcaagcaagtttctgttaatttcctctaaagcttccatagaagctatcaagatgtttcttttaatttcccctaaagcttccatagaagctactcatgttcttagttaaatgtacaatgagagaacgtcgacttgaccgatctatatataaaccatatttatgaagtgttctttgtttatgttatcattttgcctatgttttttcatagacgtacataattagtgttctaattaatgagatctaaagtcaaatatgaaaaattaattccatctgtaaaattctaaatatgaaagacatgttctaacaaagcacgtttataatttttctttcttataatttctctttttttttacaatgattatatatgctaattagccttcaactttactagaacattaatgtcaagtataaagagaacaacattatagaaaaattactttttctttaacaaaaaaaaacattatagtaaaataaataattgtgatgactagttaaaactaaaagaaaagaaaaattacagagtgaaaaactgtatggccttcttaatcttattactaacttcaagctcaagtaacaatgttaatggaaagcccttgtatacatcccaccaaatagtctttgtaaggaacaatgttaattgttttttttttggcaaaaataacaatgttaattggaagttctatctttttgtacacaaatgtgtcctacgttatatgagtaataaatagcagaatctgcatggtttcatggagagagagaacgaattgactcttaatgggtggatcctagctataagttaactttgaaaagtttttcggttttgtgactttggttttgcgtttttggtcattagtcacaccactcaccactactcacttcactagcctcgtacacatttaaacatggatattaaaattcgaatgcatgcatgcatgatccacattcagtggtgtattttgtaaaatttgtttttgacttctcttaatttatgcatacagactaaaaatattttcgtgaccgactttcgttttaaacgatcttaaacttttttttttcaaattcacaacctcgataaaaaaaaaaaaaccgaaatcgctttgaatacaaaaccttaaaaaaagaaattaattatgccattccaacacaagtttacaattttttatattctgcaatttcatgtcctcaatccgtgatgttgttaatctaacacaaatttctaatattatatttaaaaaaattgggacatgattcaataaaactagttttgctgtttaaaatcttcatatgtaattaacagaaatcgaatatcatgtcaaaaaaaattccaacaaaaatagtagagtataggccatttatttagtttctataatcccatgaaatctcctcaagatctaacctcagatatatcaactatgaaaaatatggatgactgaatatcttctttttaagaaaaaaaaaaaccatgtaataatatctatgtatattaaaaccagtagatgaaatgatgaactacatgtctaatccaatgacttagggtctcgctggtttaaacgtaacaatcatactaacttttgttttaaagtgttgttgtttatggttatgattcaattttagtggtttggttggtttggttggtttaatcaagctaatggaattggaccaggcggttatctttgattttgggattgttgaataaaccgaaagatgatgactcagagagaagccactaactgcagtggagggttttcagttttattgagataaggttttaaccaactcaagtttgtttcaacgtaattatcacattcatctttcttctgttattcttgtatctagagagagagagattccgccattgttgtaagctcaaatttgagcataactcttcctttgatctagtgaatttgccggattgattcggctccggacgtaggttagatcacaccgatctagctgaaccgagttaacaaatcgagtcttgtgttcttcttctttacttgttcgatagtgttcttgagctgagttttgtgagagttgagagattgttacaaagcttgtgaggtttaatcgaggatcgaatctataacaagtggtatcagagccaaggctattggcagatcttccgatgacgacaacgacacgagtagagattaaaacgtttaatggcgatagagatttttctctatggaagattcgaatcgaagcacagcttggttattggggttgatgaatacactgacagatccatctctaacaaagattgttccaatcgcaaagattgaaggaaataaaccagaaactgatgatgaatcttctcagactaaagaagttccggatccaatcaaaatggaaaaatctcagcaagctaagaacatcatcataaaccatatcactgatgttgttcttcttaaagtccagcattgtgtttcagctgctgagatgtggacgacgcttaacaagctttacatggagactctattcttttaagatgcttgaaactttgagcattgatcagaacgtggatgaattcttgaggattgtagctgaacttggaagtttgcagattgtagttgattgtagttgcagaagaagtctaagcaatcttgatcttgaattcattgtctgtgagttacatacaattgaaacacacaatgaagtatggaaataagaccctatgtgtgcaggatgttgtttcttcagccatgtctttagaacgagaacttgttgaagcaaaagagtctaataaaggtgcttcaacagtgttgtatactgctgaaagaggaagatctcagttcaggaatcagcagcagcagaattccaaaggtaaaagcagaagcaggtctaactctaaatcaaagctcacatgttgtatctataaaaaaggagggtcatgttaagaaggattgttttgcgagaaagagaaagatggaaggtcaagaacaaggagaagcaggggttataattaaaagtcttgaattctcagaggctttgaatgttggcgaaaagctggttaaggacatgtgtgtactagactctgcatgtacatcccacatgattgctcgaagagattggttctgtagttttgatgaaacaaagaagaccacgattttacttggagatgatcactctgtggaagcaagaggtcagggatctatcagagttaacactcacggtggatccataaagacacttaacagtgtcaagtatgtaccagaacttagaagaaatctaatctcaacaggaacgttagataaacttggtgttagtcatgaaggtgggaaaggcagagtgagatacttcaagaatgatgtcactgctctatgtggaagtttaaagaatggattgtacgttctggaaggtgacacagtgattgaagagagctgtgttgcagagaaagaaacaggaaacacaacactttggcatagcaggcttggacatttaagcctaaacaacatgaaaatattgtctgggaaaggtcttctggataagaaagatgttaaggaactgagcttctatgagcactatattatgggaaagtcaaagaagctaagtttcaatgtggggagatatgatactgaagatgttttaggatacattcatgaagacctttggggttcttcaaatgtcacaccctcactctcgggaaaacaatatttatgtcaataattgatgacaaaactcataaggtctggatattgtttctgaaaacaaaagatgagacattccagaggttttgtgagtggaaaggaattgttgaaaatcagattggaaagaaagtcaaagtcctaagaacaaataatggactagagttctgcaacaataagtttgatgagttctgtaaagttcagggtattaaaaggcatagaacatgcacttacacaccacaacaaaatggtgttgctgaacgaatgaaccgtacaatcatggaaaatgtaagatgcttgcttgatgaatcaggtctggatgaagagttttgggttgaacactacaagaaaacagtcgatttgcgagggaagaattactcgctaatccctcgcaaacagctaaacgcaagatatttgcgaggaaaacgagttcctcgcaaatggttatatgtcgcaattccctcgcaaatttttcgagaaactgttttcctcgcaaatcacacgcaattgttgactagtacttccctcgtaattacttcaacggatttgcgattcttttttaccgcctagcaaatctctagcagaatttgcgatggatttgcaagtgttctgcaacgtttttctgatatattaagacttgattagtgtctgattagccactaattacctagttaattagttgttaattagagatgattttgtatgcaattaaaagctgaaatttcataaacttgttctaaatagataaatacacatttgaagctgaaattcaaaaatttatgctacattgtttcttgttctaaagaaagagataacaaggaaaaagcaagacaatgttttcaaaatacagttgatggaggagaggatcctgttgcaaggttagctagggcagcagctgctgtctcctcattggccacctgcggttctggagcagcagacacaggtggttcatttgggttggcctgtcctatctgtgtcgaggaaccatgtcgaagaattgcagccaaagcaggatctttttcagcaagatagtcaaacaggatgtcgaagctattgatcctctcagcctgagattgaatgcatgcttcagcggcagccagcttctaagaaagtataaccgaatcatcactaggaagcattggaccactatgggctgaggatgcttcaaactgcagagatccaaccccataaatccttcctttctttcgcggagcaaccggcaaagatcacaaacactcacaaggacacaacagaaaaaccatgagaaaccaagttcaaaagaattcagacacaaagtataatgaataagctgccaagattacgagaactttatatcaaacactagagacacaacacaaacatttcagacaagtacacaacacaaacacttcagacaagtacactaaagaattcagacaagtacacaagtacacaacataacagaattcagctgccaagtacacaacataattcagacaagtacacaacagaattcagacaagtacacaacacaacaagctgccaagtacacaacataattcagacaagtacacaacagaattcagacaagtacacaacacaacaagctgccaagaaaaagcacagaagatttacctcagtaaaaatcttgttcttggaatgaacagacaatccacctgatccagtgctctccggattgtccattgagcacatatgagactcttcctcttctatcctagatgtcacttgcttgtaaatctcctttgacttcccatcgatgaaagttccatccgcttttctgtgtgtctcatctagcagctcaaggaaatcaggagttgtttctccagtcttttcacactgaaacacaaagagataaacaagttagattcataaaattgtagtttaagtaatggtaaggagagaagaatacttatcttacccgttttcttgcacgagctttgtatgaggtctggcctgaacgatgtttatagatgtctttgccatccagatcatgatatctagcatttctgctgttgttactctttttctctgactttggatcttgccaaaactgtactagacctttccacacatcaggatcaatccattttggcttggcttcatcacccttctccttccaatttcccttccaccttgacacttgattagacatcctagactttagctttgcttcaaactcaacccttactcttttgttaattgaacggtcccagttatatacttgctacaaaacagacaaagcaaacatcagactatgaaaccaaacaacaaaacaagcataaacatcaaaagagcacagaacttactgcaaacgtttcataccatcgatcgattgtagcctttgatgtctatgaccaattggcatgaggttctttgaaatctctttcaaatatgctgcggattgttgctgcaactatagagtcatcgtcaaacctacaacaacagcaacaaaacacataaggatctctatgtctttatacttctaagaaactacaatgctaagtacaaccaacctaaatccagagacttctaaggcaggaccaaacttctaaggcagaaccaacctaaatccataaacttctaaggcagaactaaccaacttacaagacctaattccagagactataagcttaaccttaccagagagttcccggaggatgctttgggtctagccttgtcaagccagcacaaccaggactatcgaggagctcttccagtgtcagattgttgagacggtcaacttgaacatcataatgattgacagaaggctgagtcgttggcgttggaggcgatggtggaacggttgaacctgaacgtgaacctgaaccttgaacccctgagatattcccaccactaacaggagaattgacatgcaacgggtcacgctgctgttgtctaacccgtacaaaagtattatccgacggcatcttgcacaaaaaacaaatcaagagttagatctgggaaaaagaagtaagatcggagaagaagaatgagttagatttgagagaagaacttagatcggagaaacagaggttacctttgaggcaaaacagatcgagtcggagaagaagaaacgcggcggtgtttgaatacagatcgaagaagaagagaggcggcgaagagagtctgcgtcgtaatcagatcggagaagaagagaggcggcgatgagtataacagattagagaagaagaagaagagaggcggcgacggaatcggatcggagaagaagagatccggcgccgaagagatcagagaagaagaagagaatcgaagaaaatttttagggttagggtttgatgcggctggtttgagctccgctcaaactaggtcttcgagtatatataggaatttatttcctcgcaaaaccctcgcatagtttgctttgaaattgcgaggaagatttttaaaccaattaaaacgcaccacatattgcgagggaattgcgagaacacctagcaagtccctcgcaacttatgatttttaataattttgggtttagggtaaaatttacgacggaagtgcgagtgcgtctagcaattccctcgcaatccttcaaccaattaactccaccattttgatttagtgtttgaatcagatctgatttagattcacctatttcgaataagactcccagcaaattaaaatatgactaaatattttaaataatttaaggtttatggtaaatatttgcgagggaactgctacgacagacttgcaaatctctcgcaaaaacctcgcattgttgaatcaatttgaaaaaacaagaaaacactacttaaaattattcggattagttattctgaatcattaggaagttaaatatctacattagaatctaatttcatctcaaaaacttcaaatgtgcatttttcccaaatacatcaatgatgaacttatgtgttttcaataatatgaatcataagtgtttaacatcttcaatatgaaatgtcatattgaaacatatacaatatgtttttgtgcatcaccatataatcaacttgtatgattatacagtcatttagatttacatttataaatgaaaatcaaagatcccaaatcacttctatgtattttagggtttagggtaaagatttgcgagatttttgcgggtggtttgcgagggttgatattgttcattgcaaagtactcgtactttcctcgcaaatttgcgaggaagcagtctctcgcaatatttgcgagggattagcaatgtgcgtccgtggtcttgcaaaatatctgcaattccctcgcaaatttgcgagggattccttcccttgcaatttttcctcgcaaaacgactgttttcttgtagtggaagcagcgtctactgcagcttatctaatcaaaagatctccctcaacagccatagatcataatgtacctgaagaattgtggcttaatagaaagccaggatataaacacttaagaaagtttggctcagttgcatatgctaacttggatcaagggaaactgaagcctagaacacttaaaggtgtgtttcttggatatcctgaaggcacaaaaggataaaaagtttggttattggaagagaagaaatgtgtgataagcaagaatgttatctttaatgaggcagcagtgtataaggatctaagtactcaagtctgtgaaggaaacgatgatggaaatgcacttgtcaagtcaattacagaaacagaaatagagaaaggggaaagttctaatctaggtggagttatagagctcgatgtcagtgattctgaacctgagtactttgaacctgaaggtgaagcaccagtaagtgcataaagtttgagtagctacaagctgactagagattgagttagaagacagattagacctcctacacgattctctgactactctcagtttgcctttgcactgtacacaacagaagaggtagaaagtgaagaaccgagttattttcatgaagcaacagaagataaaaactgggaaaagtggaacggtggtatgaatgatgaaatgaattcattatggaagaactttacttgggatattgtggaccgacctaaagatcaaaaggtcataagttgaaggtggcttaataagaagaaaccaggcattccagtggtataacctgagaggtataaagcacgcctagtagcaagagggttcacgcagagaaagggcattgactatgatgaagtctttgctcccgttgtgaaacacacatccatcagagtactaatgtcaattgtagctcaggatgatttggagcttgagcagatggatgttaaaactgctttcctacatggagatcttgacaaaccattatatatggagcaacctgaaggatatgttgtagatgaaagcaaagatcaagtctgcttactgaagaagtccttatacggcttgaagcaggctcctcgacagtggaataagaagttcaattcattcatcatggatcagaattttacaaggagtgaccatgactcctgtgtttacataaaggaggtaaatcctgatgagtatgtttatttactcttgtatgttgatggcatgttacttgtagctaagagcatggtggaaatcaacaagatcaaagaagctttaagtcaaggttttgaaatgaaagacatgggtccagctagcagaatacttggtgttgatatcatcaagaaccgaaaagaaggtacaattagctgtctcaggctggttatttggaaaaggtgttacgcaggttcaatatggaaaatgcaaagccagtgagtacacctatgggagctcactttaagctagcttcactcaagaatgaagatgagtgcgtagacaccgaaaaggttccttattcgagtgccactggaagtgtcatgtacgctatggtgggaacaagacctgatatagctcaagcagttggagtgctaagtcgtttcatgagcaaacataaagaagctcactaggaggcagtgaaatggttactgaggtacttgaaaggctcgattgacttgaagttagtctattcaaaggagagtgttttcaggattcaaggcttcagtgactcagattatgcagcagatcttgacaaaagaaggtcaactacaggttatgtgtttactgtgggaggtaacacagtcagttggaagtcaaatctgcagaatacaatagccatacctactactgaagcagagtatgtagccataactgaagcggtaaaagaagcgttgtggatgcagggtctgttgaaggatatgggagtaaaacaggataaggtacttgtgtggagtgattcccagtgtgttatcagcttgtcaaagaaaaatatgttccacgaacgtaccaagcatattgcagtcaagtaccattttatcagagacgtgattgagaatggtgatgttgaagtacttaagattcacacgtctcagaacccggctgatatgcttaccaaagtcattccagtgcagaagttctaagcagctttagattttctaaagttgctcaggtaagtgacttgagtcactactgctaaaggttaaatccatggttgtgcagattcacttagaaagaaggaaaattgaatcaaggtgaagtgttgttgtttatgattctgattcaattttagtggtttggttggtttaatcaagctaagggaattggaccaggcggttatctccggttttgggattgctgagtaaaccgaaagatgatgactcagagagaagcctttaactgcagtggagggtaaccaactcaagtttgtttcaacgtcattatcacattcgtctttcttctgttattcttgtatctagagagagcgagattccgccattgttgtaagctcaagtttgagtataactcttcctttgatctagtgaatttaccggatagattcggctccggacgtaggttagatcacacagatctagttgaaccgggttaacaaatcgagtcttgtgttcttcttctttacttgttcgattgtgttctagagctgagttttgtgagagttgagagattgttacaaagcttgtgaggtttaatcgaggatcgaatctataacataaaggattttaatttctttttgtctaattcacaatcttggtacaaaatcgaaatcgctatctctagtgtgaaacatttgtatctgagcagacaagaagtatgaaacaaagcattcaaagctatctagtgggttggaatctatcctgcttgtcgtaccctcaaggaaacacccacgagtcaatatatcccacaagatttatctaacaacatggtacatttctgtcttactctcccagtgtacgggatcattaccctaaacggcctacaagcttcaagaatttctgatgccttctccggatccacaatgctatcgtaccaatcaatgtggccatgaatcaatagaataaccacatatactaaagtctgaatattagcgtatataatgaaatatcagtttctctgtgaaaataaaataaaataagttatgctgctgaaatttagagtaaatccatcaaaaatgttttttcagtctttgtatctgggtattttgtatactttgactattcttttttttttcttagaaatatatactttgactattcacaatgtttaagaactatatcttccaataaattttgaaattttatacacaggttttgtttttgttttttgaacaccaatacatagctataaacattaattattacacatacgtgataaattagtttgcttgtgacctataaaagcttatgcataatcctatatatacgatttatatatgttaagtataaatgtttgactgttttttaattgatgaaaaaatgttttttaaatttttagttacacaaagagtggtggtaataaaacgaaagaataaccagttgttcaatatgactcaaatactagtttagaattcatttcgaaattctcggatttaaagaaaaatgagtccaaacgttaaaaactaattaatgatatataatattttgataatttaccaatttggaactttttatttatagaaaacttagtgggactcacagccagtcaccggtcagtaatgtgtgaggtattccattaatctcgttgacttagctcaaccattgtctattgtctgttgaaatcaaatttttacggagaacaaaagtttatgcaaaactaatattagtaagtgtcttgaaatattaaatattttaaaagattagctcaactcaaaaccttagtctttcaatttatatgatgaatctttcaaaaccaccacaaaatctttatttaagcttgtagatacattagacacatcatcacaaaattttcgtacatgtttgagtctatgtgatttatttaataggcattaaatagaaataaagcttttaataatttcaatcacgtgtgaagcggcgattgaattgcgaacggtgatgagatgcatttctattttctgatctattttttctatgaacaagtcaaaagtctttctaatagaaaaagggaaaaagaaaaataattttaagtaatttagtccaaaaaaaaagaaaaatctattatgagaattatgctaaaaatagttttttcttatctaaagctcctatatttgactatcaaccaaggattcaaagttttactaattaggacaaagtctttgaaaacatttcgtagattagagtgctttttttagaaaaaatattcttcggtgagatttttcagtagaatagattggtcaatattaatttatataatcccaatatatataactaaaccctttaaagaaaaaaaaacattctagatgatactacgataatttaccaatttagtactttttatttctttttatctgtttattagttaaaataacttttgttgtttaaacaaattatgtcacttaaacgcaaaattcaatttcgttttctctgtttgttttcctaattaaacttttagtagagtatatgaagtacgtaattaaccattttccaatattagtcaagtgactttgacttttttgaataaataatcttctagatgattacagtttagtcccaaattagtaaaaatttcaagggtgatttaaataaataacatgttaatttatctgatatcactgtatttcaataaaatgtgccgttttgtatttcttttgcttatgacatgttaaaacagtaaaatattgcagttaatcaaaaacaatagtctttcatgtattaattcaattttactcgagtacaaaaaagtattaatcaaaacatatgcatttccattaactagttaaaatgaccccgacttttgtctatagaaatataattttatgattgattgacgaggattttgttataggttgtgttagtgttttcgttatgttatagtggatagtccacattgttgacacaaattatatgattattaaaattctaatttatgtatgatttaaacaaacaacatgttaatttatctgatagtaagtgttactatcagaaaacacgaaactttacaccttaatatataatacgtgtttgctaatttacccaataacaacttatcttactaaatatagaattttgctaggatacgaaaacgtattttaatggtacattttctccaatttactatattttctatcataatacgtcaagtaattctttaagagaagaatcaacctaattttttaagaatatcagcaaaccgcaagaagtggctttaaggaaaaaaacaacttctttaataaatcatacctcttcgttgacaaaaaaaaaagaaaaaaaaagcacacaactccctctcgtaagcaacagttgattagttttactcttttcgaattgcttgatccaacaacacgtctgtaatataaaacaaattgttgggtcgtatgatatatttgttaactttggacaaaaaaatgacatgtttgttaataatataggtctatgacgtcgacactgacgaaaaacgaaccaaaacaaatcttcacaaatatctttccacgagaatctaagatttaaaccgatattattatgtagaagcagacataaaacaaatatagacaacaatattgtctttatataacaatattgcttattaaaaaaaaaaagagagttataaataatattagtagaaaaaattgacaatatctgagtccacgtcaaaaccctttttgtagccgaagcatctggttctctatcctcgtctctaaccacatactagacaaagtatctctcatatctctctcttctaagatatcttcttcttcacctctctatatatggatgattagatatggtacggaacaatcactcacacacaaaacacactctagatataaaggattagatacgtaacatatcctttttttggttactagggtttcggaaatttggatatcaaattttaacatcaagcaaatcatcatccgtacgtactcattcatacttttgtaacaaaaaaaaaaaacaatctaagatatctatcaagatcttaagatatctacatttatagagatgtttcgttttccggtaagtcttggaggaggtccacgtgagaatctgaagccatcagatgagcagcatcaacgtgcggtggtgaatgaggttgactttttccgatcagcggagaagagagatagggtttcacgtgaagaacaaaacattatcgccgatgagactcatagggttcatgtcaaaagggagaattcacgtgttgatgatcatgacgatcgttctactgatcacatcaatgtaagcagatggttaactcatcgcttttgttttctttgttttttttttattatctagaagttcaagctaaaaattctacatttccgatatgcgaaacccacattagattaaattcattttttttggagaagagatcgttcccaacgtgcatcaaacccagtacatccacatgagaaatttaccactggaccaacagctcgttggttacttcattgttttccttttcgtcaatatcatttaattacttcggattttagttagtaatattataaaacaataatttcgttatatagatgaaaactttgttcattgaaatgtgtatgattattgtaaatagattggacttaatcttctcactgcgaatacgggaagcgacgagtcaatggtggatgatggattgtctgtggatatggaagagaaacgtacaaagtgtgaggtacacttattattcaattagtatagatcatttttgagtaataataacaaaaaaaagacacaactagtgtatttatcgcacgaaccaaagaaaaagagattgtcaaaatccaacaaataaaaaatgattgtcaaaaaccatcaagagtgtatatttttgtgcgtctgttacgtacgtaaacaattttccgcttttctgattcgtcagaattttaaataatatctgatgacaaaaaaaataaaaatatttttatgctaaattttgattatttttactgttcatcttcattttgtcacataattaagcataaaaagatattttctgattttctctacaaattttttatttcttaagaattagtaaaaatataccgttttcgtagacttagacattctatttttatatgttgttcgtatcggtccgtaagatccggacatgttagagagatttactctttcttactagaatgatttaatgtctgatacatgatttttttgttttttaataaaatgaagaatgcacaacttcgcgaagagctaaagaaggcgagtgaagataatcaaagactaaagcaaatgctaagtcaaacaaccaacaacttcaattccttgcagatgcaacttgttgctgtcatgaggcaacaagaagatcatcatcacctagtaattaattaacactctaatacgtcttaatcatttatttcatataattagttaaagattttatacccttgtttttcatcaggctacgaccgagaacaatgacaatgtaaagaaccgacatgaagtgcctgaaatggttccaagacagttcatcgatttgggaccgcattctgacgaagtgtcgtccgaggagaggacgacggttcggtcgggatctcctccctcgcttctagagaaatctagctcacgtcaaaacggaaagagagtgcttgtaagagaagaaagcccggaaaccgaatccaacggctggagaaaccctaacaaagttcctaaacaccatgcatcatccagcatttgcggtggcaatggcagtgaaaatgcaagtagcaaggtcattgagcaagcggccgccgaagccaccatgcgtaaagcccgtgtctcggttcgtgctcgatccgaagctcccatggtaatactaattaatcttcctctctagaatttctatgaagattgatctctacaaatgtttttggaggttcattaacatcaatgacattgttttacagttaagcgatggatgtcaatggagaaaatacggacaaaaaatggcgaaaggaaacccgtgccctcgagcttattaccgttgcacaatggctgttggatgtcctgttcgcaagcaagtacgttacctaaacaattcacacatctaaaattatgtttgaaggtgatcaatcaagtgtaataatttagagaaaaaaaaaataatgtattgtaacaaactcatgatgacctaacaggtgcaacgttgcgcggaagatagaaccattctcataacaacctacgaaggaaaccataaccatccattacctcctgcggctatgaacatggcttcaactacaacagcagccgcaagcatgcttctctcaggctccaccatgtcgaaccaagacggtttaatgaacccaacaaatctcttggctcgaaccatattaccgtgttcctcaagcatggctactatctcagcctctgcaccattcccaaccattacattagacctcacagagtcacccaacgggaacaatccaaccaataacccgctgatgcaattctctcaacggtctggtttggtggagttgaaccaatcggttttgcctcatatgatgggtcaggctttgtactacaaccaacagtctaagttttcgggtttacatatgccgtctcagccgctaaacgctggtgagagtgttagcgccgctactgccgcaatcgcctccaatcccaactttgccgcggctctagctgcagccataacttcgattatcaacggttcgaacaatcagcagaatgggaacaacaataacagtaatgttacaacgagcaacgttgacaataggcaataacatttttttataagttttagttagggactttttatcggtcgattttgttttgtttttcttttattacattattttttagttacggcttttttttgttttttcttttctttcccaaacaacaagtattgagagcaattcccccccccccccctcttttccttctgtatgatcgacaattgtgttcagaaatataaaattgcttaatttttccagaagctattaattcttatgaagtcatcaaatgcgcatctatgtgccattaattatgatcaaactcgatgtattgtgcctaaaacggaagctcaacaagcaaatgctttaggcattataaatatattatgattttagggcatcaaatttaagaaatctccttacagtgtagccgtttgtgtaatattttattggtgggtcaataatattttttgctttagggagcccaaacacttagactctgaacatcggtacgatgttttatttgtggtggatatatggaactgctattaacgtacttactcactctaaaattagtcgatgctgacctcaagagtttggcttgtgaaaagttgatgaccagactaaatcgatatgtcacttgtcaagtgtggcattattttaaaggttggttaaatatataatttaagtgaaagattggacattttatccaaaaaaaaacagaattagactggattttgagaaagtgaagaatgttcccgcatacgcaaatagaaacatagttgagaaactaggatatctacatttgtattataaaataaattatactatggctttgaatgggtccatatgacgtggattggacaatgcgcatatcaatattttaataagaaaaatgtcggaatatagtatatatggagcaaacaatatgttggtataaagtttatatatgatgatatggagtttttggagagtagaatgaaaaaaagtcagactaacagttaatttataatggtatcaaattttatgctaagtgtgtactagtatgaaaatttttagtctgcaatagatacttatccttaatagtgaacggtaaattaagcagaggtttttacatatttggacatttaactctaaaaactctgaaaaaagcactttttgttagggtaacggagatggacatattctgctataagaaataacggttttactctctatcatcttcttctttccttcttttttgtttttgatgagtgaaatcgaaaagatagtatagggattccaaatggatcccaattaaatttgtattgatgagtaaaatcttaaccctaatgagagtatagggaactcaaatgcttcaatcatagacacatatcgaatcaattatgaattttaattaaaaatctaaattatttgagaactttggatagggagttacttggataaacttgatccatggagttctttgaatcccttatagatgacaacatcttatcaatagagacggccttttcattctcacacagactcttatctctcgtaacaaataatttgggattattttaaaaattacacttaaaagctgatcctaatttcataagaaccataattgcaaaatcaaattagaatctaaatacaaaccaccgacgaattaccttattgatttctttgagggaaaatgaagatcatgacttgctatagagacaaaggagagaaaaaatggtaaaatggtcactcaaatgagagagaagtacctaattctataagaatattgaaaaatgatatgagagacaatgacacaaagttttgaaaaatgatatgagagacaatgacacaaagttttttgtgctttatctataattgatccaaattaagcgtgaactaattcgactttagtatggtctgcatcttactacacaacattcaaaggctatacatgttttcaatcaaatcaatatacattcaaagcctatatgttttttaatcagataaacagccagtagtcacatcttttacgtgctttcactagtacttatacactctaaactatatgcatgccttgaatggggaatagtatttagacactaatttaggggttagaatgaaagaaagaaaacttgaaggggttagatgagcaaatatgaaaagttaaaacttcaaggaaacgtatgcttatgggtcccacacagcgtcaacaacgtgaaggcgtttgcttgtgccacaaatcaaagcaaccttatattttccatttgcagcaaacaccaatcaaccaaagtaacaaaccatctattattaattattgtgcaaaaaaaaaaaaaatccttcgcacgttttaacattttattgtgaacatttcagacatttagtgtttttctatgtgagtggagataaaatttttttttttttttttgaagaaatggtataattggggtggcaaagttaatttaaagacgttactgtaacactgtttaagaaaggggttcaatcatattgctctttgctaagctggacctaagcatgggttcaacgtgaagcgtacctaatgctaaacaaacccatatctacggatattttgctaagtataattctcatccattaaaaacagttagacaaataaaatatattgtcttaataaataaataaatgaatgagacaattcttctggattttaaaacaattctttttttgaatcagacaaatatttaaaaattaagatgatagatttaaaaatttcgttgtttatatatatcttggttttaaacctatattgcttaagatcctacttttacactttcagttattatatacctttttaaaaatatttttttattaaacttactatgatttcacttatcttgtagatttttatttagtactaagaaaagttatttatattatataaaatgaataaaaatttagttgagtaaaagaaattaatacataaggttctcttttgaaaatagacatataaggctcttccttgcacacttcaaatagaatgaatttgatgtggaaaacagactaaaccaagatatcatcctagaagatatcttaactatgtacttaatagaaaattgaaaagaaaactttatacttatgcaaaaaaattattaacttttacttaagagaacaattgggatcaatatgaaaataagatataacccaagggtcgataaattaaagtgaattaatatgaaaatgaactttatccttaataaacacaaaacgaattttgctgatctgtctaggtccacgcatagcaagcaaggtttcataaacgtgacgcttgcttatgaaactaactcacacttataactttaatttaattccttcatattcttcaaaagtttccatttacaagcaacaactaaactaattgacatttgacaataaaaagctgaactttattatgtatctctaggttttttccttgagagtttctctctttgaagtcatttacgtatatatatataaacccttgcaccattcttcttcgtcttgttaagcttttaagaatctctactcacattttctctgtgagtgttcttttatacttctttgttatttccaatttttctttctttcctctaaaaattttaggaactattgaatcatttaatttctgtttgttgataaaatttcgatcaactgttctcggcttaccgatgcattttttgtaaaaccgtctttttttggtgaataaaattttaaattcatacaaaaaaaaaacatatttgatactattttagctccattgtatctgaatcttcatttgttaatttttttgtttcctctgttctcacttgaattttggaatattttctctaggttttaccttatattcttcactttaagaactatatgaagatttgattggaagtaataatattcggtgatagaatctgagtttgtttgattctggtgtggggcttatatctaacttttttctttgtaccaatacattttcaattttacatttttgattagcttaaaatgtgaaggataccttgtaaataactattacactattgcttgtcttagtctaatagtcttcactaatattttgtgcagtagaagtaaatattataaagagttgttgtttgattatagagagttgttgtctattctttaacttgatgtgatgttgtttttgatgacaggtaaaaatgggaactaggttccaatcattcttgctcgtgttcttgctttcatgtttaatcctcatatcaactgcctcgtgtgagcgaaatggtgatggaacgattagaattggattgaagaagaggaaactagaccggagcaacaggctagcttctcagctttttttgaaaaaccgagggtctcattggtctcccaaacactattttcgcctgaacgatgaaaatgcggatatggttccgctgaaaaactatttggatgctcaatactatggtgacattaccattggtactcctcctcagaagttcactgtgatctttgatactggtagctccaatctctggataccatctactaaatgttacctatcggtacgcgttagtttgttcttaatgcataataattctgaaaatcctattgtattcttactcccaaaagaacaaaacaaaatatctatgtttaatgttttttcaggttgcttgttatttccactccaagtacaaggctagccagtcatcgtcatatagaaagaacggttcgttctctctgttcatcttgttatttgatactcgagcttcggtactttgatgtttcttgataactattcaagaaagggatacatttagcgccggtcttttgatatgtttgctgataggttttgacgataaaactcattgtcattataggaaaacccgcgtctatccgctatgggacgggtgctatttctggttactttagcaatgatgatgttaaagttggtgatattgttgtgaaagagcaggtaaaacgattcatccgcttacatatttcagaatattcatgtgagttaatatctaactgctacatctatatatcaccacaggaattcatagaggctactagtgagcctggtataacattcttgctagcaaagtttgatggtatcctcggtttgggtttcaaagagatttctgtaggaaactcaactccggtttggtatgaaaacgtttttgatctataatctgatgaaagaattgttgttgcaattctgaatgatgaaatttatatgatgtgtgtaggtataacatggtagaaaaaggtttagttaaggaaccgattttttcgttctggcttaaccgtaacccgaaagatccagaaggcggtgagattgttttcggtggagtcgacccgaagcacttcaaaggagagcatacttttgttcctgtgacacataaaggttactggcagtttgacatgggtgatctccaaattgctggcaaaccaaccggtaagtaagcttttgagatgtttcagtttcaacataaatgagtccttttacctatgatatgacatctgacttctatgttattcaggatattgtgctaaaggttgttctgctattgctgattccggaacttctctgctcaccggtccatcggtgagaatcatttcactgaaacttttgtagattgtacactacttagcacctgaaacatgctgaatatttatatttgcttgtttagactgtcatcacgatgatcaatcacgcgataggagcacaaggaattgtaagccgtgaatgcaaggccgtggtggatcaatacggaaaaaccatgttgaattctcttctagctcaggtttaaatcactggtcatgacaccattcacatttttataagcaatacaatcttgaattttacatcacttgacttgcaggaggatccgaagaaagtatgctcacaaattggagtctgcgcttatgatggtacacagagtgtgaggtcagtactgacactatccagtcaaaacaaatatgtcaaacataaaactgattcatgtctgtctgcagtatggggatccagtcagttgtagacgatggaacatcgggtcttttaaaccaagcgatgtgcagtgcttgcgaaatggcagccgtgtggatggagagcgaattgactcagaatcaaacacaagaacgcatactcgcttatgctgctgaggtgagtttcgagagtgtcttgaaagccttattttggacataagcatgttaagactctaatctctgtaaaacatgtatagctatgtgaccatataccaacccaaaaccaacaatcagcagtggactgtgggagggtttcgtcgatgcctatagtcacattctcaattggtggcagaagctttgatctaactcctcaagacgtaactactctcatcagcttttccttaagttttcagcttacaaggagagtaattaaaaccttttccttcttcttcttttggtcgatcagtatatattcaagatcggggaaggagttgagtctcagtgcaccagcggtttcacggcaatggatattgctccgcctcgtggacctctctggtaactatcatctacaaatacaatctactaaccaacaaactcaaatgggttttgctcaaaattttgtacatcgtgtgaaaatgcaggatcttgggtgatatcttcatgggaccataccacacagtgttcgattatgggaaaggaagagttggattcgccaaagctgcttaaacaatatctcttctttaataccctcgttttttatatgatgtttgtgaatgtgtttgtaataacttaaaacatattgctatcctagaatggtatcatcttaatacagatttttatttggtttcagagctgtttgatttgctttaacttacagagtactaagtgatcataatgagtcccaaggcttgagttctctgtcacgatccatgtgtttcctaatcacttagcctttgccaaagctagtgtcattgacctcgctcgcagggttaggaaaattcccctgaaaaaacaaaagaagaagaatgtggagattacaaacaagtttcagttgagtaacaacaacaagaactagctgcagcaaatgattcattgtcttaccaaaagaatgcgaccaggctgtgcaagatgacccggaagtgcagtggcacatacttgtagttaatccatcccaccaccgggaaaaactgtgattgatatatagaatcaatcatccagcaattcttgttatgattcaaattctcttaaaagagcatgaactatattgatgatatctatcacttaccgtccatgcagtaagctggaccgttggataagtcttcttgatcctttctctaacaagggtccagggagttcctgtttcactcaacattgcagaactcttaataccatccacgacggttcgtgttttacaaatggagtgtgaaaaagggaggaacttactttctatgactactccataatagatcatgaaaagcaaatggttcaatggtgacaatgtcaattgctccagaattacctaccactcaaacacactgtttaagaaaacccccggatcaatctcgaacatacaaatcatcgaaaggtatcgaacattgttaccttctttgcaacagtctgtgtatccttcttccctttaaaaaacttatctaaatatgtatgaaagaaatgccctgctggtccaagaaacccaccagcaaatatctgttggagaaatcaacacagaactcaaatggtaaaacatatcaaagaagctaggactggcttgaacttaggactctacaagagaaagattcaagctttaccactttgagaagaacccttctcagctgaatcttctgtatgccagagagcttctgtgatacaacatcgctaacaccagacaaaactccagcagttattgcctacaaatcacatgaattccaactacttgtaaaacagagtcaacgatactctcagataatcagattatgaaattgggttaggttaaaaaacaaaactttcaatcgaaaaacaacgtcatcgtctctcaatcaatgaaactaaacctaatctcaagaaaacgaaaccaccccagaaaactacatcaatcgcttcaaatcaacaataggagaagaaaagtttcaacctttgttcttaaaggatgttgttgaagctgtgacaagtaccgttgcagagtcgtcttcttcggtggtgaagatcccatttttttggattcttctcttcgatactctctctagtgttttgtcatttgtgtcttaagcaatttgaccaaattcctacctacaaaacaaaaccgaaccggtttaatcaaaccaatataaaccgagccggtttagatgtaattaagactcgttctacgaggatggcgggtaaaattgggaggctagctttacggttagaccaaaaaccgtcacaggagaatctatcaaagcctaattggtctttggtcaataattctctctttggtcaattcaattccttaaattttcttgttttgttttatgcctatcatcttaaacctatatataacaccacacataacatttctctcttcattcatcaaacacaatcacaaatctcctgagagatattaagaaaccaacataaccaaaaaacctatcaataatggcttcattgcaggtatcaagattagttctttcgtcatcttcttctagtacaagacctaaagcagcagtttcaatcccgaagctaccgaaatttcacgtctcggttccgaaaataccgactttatcggttaaagaaccgagctttgagtttgtagaaagtcttcctctttcgttgaaacaaaagagaggttctgattctatccaaagaactcgtctcaatgcggttcttgaagaagttatggataggattgagatgcacaagaacatcggagatcaacgtaacaattggaactctttactgctcaattctgtcaacatgattactctcactgccgctttgatggccggaatagcctcggttaacggtcacggtgtagattctgtaaccgctgtgaagatagcttcaacggtgttgttaacatctgcgacgggttttgctgccttgatgagcaagattcaaccttcgcagctagctgaagaacagaggaacgcgacgaggctgttcaagaagctgagagtcgaaatcgaaatgtttctgagagaaaacgaggagatcgaagaagaagatgttaaggaagtgataaagagagtgttgtctctagataaagcttatcctcttcctctgatcggaacaatgctcgagaagtttccggaagagtttaaaccggcgacttggtggcctgaaaacaaggagaaaaaccctaaaactagtcttgcgaatggatggagtcaagagcttgaggcggagatgagagaagttgctcatgtggtgaagagcagagacgcagaagagtatgagaaattaggtcacgtggcgttgaagctaaaccggttcttggctatctctggaccagttttaaccggagtttctgctgtaagctctgtctttatcggtcaagattccggtttagctggaatcgtggcgatgacttgtgcttctttggctgcggttgtcaacactttagagcatggtggtcaagtgggaatggtgtttgagatgtatagaaactcagctggattcttctctctattagaagaaactatgaaatcgacggagaagagagagaacggacaagtgtttgagacaagagttgcggtgaagctagggagaagcttatcagaactgagagatctcgcgaaaagatcgaatctctctcaggttaaggccaaagaattcgctagcaagcttttctagtttttcttagagagaacattcttcattcttttcttttttttgtatagatgaatttgttcattcattctttgttaccgacatattatattagcaaatttgatttacttttacaaagaaatttgtcttttgatcgaaattttaaactagagtttgaatgaaacatgaatctttgtcctgatcttgagcattttaatgaaccgaaatgatacgaccgattcaaaacagaaatgaaattattcaacgaatttgacccaatctaaaattaaaccgattagggtaaagaaagttcactaaaaaaacggactcaatcgaatttttaatttaatttattaaaccaaatattttttaatataacatatcctcaaaaagagtttatatttcactaaagaaagtttactaaagatgaaattaaagaatttaaaataattatttactcaactaaattcgggtataattcggtgacaatgtttccataccaaagtaaccaaaataaacctaattatccgaatatccaccccaaattacatattttttgtatcttactctatccataatcttttaaattttggtaatttcgaacctgcgacttaacatctgttattgggttctacggaagtcgttaccggttaacggtaaaatataaatcgtggttttttagaccacttttttttgcttttctaatttcacttaattttgttaacgccgttaacgatttccgtaacgcccaataacagatgttaagtcgcaaattcgaaattaccaaaatttaaaagaccatggatttaaaagacaacaaaaaataatttagctatttttattccaattttaaaattacaggtattaaacggccaaataaaaaataaaccgcggtttttaggcttttccttttaatatgtattctcaaaaagaatttatactaaagatgaaatttaaagaatttaaaataattatttactcaactaaattcgggtataattcggtgacaatgtgtccataaagtaaccaaaataaaccgaattatccgaatacccaccccaagttacatgtttcttgtatcgtactctagtttctctagcaccaatgcagatgaggtcagaaaataatggaatattcaccgaggatacaagactgtaatcgagacctcatccactgaaaacggatctttgtctttacgctcactcatggacctattttcaggtttcaccgagagaggcagagtgacgaaagcagcttctgtaggtttaggtattgtaaaagtaccgtctcttgcaagccaagttattacagagttcatggttggtctctttgctgcattctcttgaacacacaacaaaccaatctgaatcaactttatgatctcgtttcttggattctcgtttaagtaaggatcgattatactctcaagctctccttctatccatctcttccatgccttatatcaaaagaaaacattctttataagtcaagtgatataaatttcgtgtaaacaattatatttttttctttagtatgtttaaaataataacaaattattgtgcaaaataagtaaatatatacccacttttttgcattatgaattatttacttgtaattttatgcaaaaatgcaaatcttgggtttttgcgttttctaatacaattatgcaaattttcttgattgacaaatttcctgcttaaccgcattagaaaacgtcattatgccattatgcgtgttaccaatcaaagcctaaaagtgagaagataaataaaatgtgatcaagattcaagaagcttacaaaagcaggaagtccttctgtttcaaagttcttatttttttcaccacttatcatctccaaaagcataacaccgaagctataaacatcagatttagctgagaattgtccatgtctcacgtactccggagccatatatccgctgcatgaacaaaaatcacattagtatccatgtctaaagcagagcatttatgtgtgaaatagagcagacttactaggttccaactactctgcttgtctctcctcgagtctcatccatgttaaacaacctcgccatcccaaagtctgcaactttagggttcatctccgcgtctaaaaggatattgcttgccttcaaatctctgtgaataatcctcaactgagaatcttcatggagataaagaagtcctcttgcaactccttctatgattctgtacctcacatcccatgtaagaagccaacgtttgtcttcgtctacatattttgaaagaactctttagtctgattaacaagttttgtgtacattggtcatgtaaaggcttaccaaagataaagtgatcaagacttgaattagggacatgctcgtagacaagaatctcttcatttccttcattacagaatccaagaagcttaactagattcctatgttggagtcttgtcaagagtaagacttcattcttaaactctagttctccttgtcctgagcctccagctaatctctttaccgctatctcttgcccgctcggtaatatcccctgagaccggtataagatcactgaccaaaatctaaagattttgataacactttacaaggtttgatgaaatttcttaccttgtagacagatccaaacccaccttgtccaagcttattttcaagggagaactcattggttgcaattaagatcatgccaagatcaaatcttaacgtagcttgaccatcagaatcagaattctctgcacatattttgaagcttttttcattcaaaacaacactccataactttccaaatgtttactcaaaattcttgatactcactattgatttcagtataaatcctcctccgcatccggcgataagcaagcacgaaagcgacaaacacggcaagatttatgcccgtagggaaaacaacaaccacaacgctccatggttgaaacattcttcctgaagaaaaggttaatgtcaagtcaattcaagatttcatcaagaaaatcaattctagtacctttcttgacccgataatcttgtcgagtttgaggagatcgaggaggcgcgggaactctctctaggttatcgaaagctcctgcgaatctgtaatcatcccatcggaaataacaactaggacgggcaactgttcctccaactctgtcccagttatgttcttgattatacctaacattttctctcagacaatgattacagtcactggaagataaatcaggtgtgcattgcatcaacatattaacctcaggagtgtctgtaaactctgcacttgagactccataatacttcaataccgaagactcatcagctgtggacgcaacctcaactgttcgattagccctggcggcaaactcttggctgattcgggttagattggaagaggggtcaagactcgagtgaggaacattccctattggctcaagctttagtttgccaaatctatggatatttgagtagcgtactagacaagaaacgtttgcatcgttttcggaatcccagtgatatgcttctgttttgcctcggcattgtgttaacagagtcctacttgctctatcgacgcagcgacgacaagcttgaacttcgtagtgttttcgacatagggcaagagcgtaaactccgtctagcgaaacgttgtagaaaccacgttctcgtatgacgtttgaagcaagagaaggcaagagagattcgaggttttcaacgtagcttgtgtttggagagaagtcttcgtcgccgcagacgaaggtagtgtgaacgccattgatgttgaagagaagaaataagagaagaaaacaagggatgtggaaaagattggatctttccatttatctattaacgtttccttattaaaacctattgtttggctttaaataaacagattttgatttgtatttattctcttggagaattgtggatcaaatacgaagagacttttctatcacgaacacttgacttttagggtgacgtaaggagcaaggcaaaaagacttttcttccctaaattgcgcttacgtaaacgatacgtcgaacacttcgttgtcattatgccttaagtggcatgtaaatgtcttcgatagtaacactggaaagagcgacgtcgtttccgcttccaaatagtttggaaactacaagggaatgaatatgaaacgagtcaaggcctagtacgggtttcatatactgtcaaggatcaaaggacaagtgaaagtcaaattaggtgaccaaaaatggtttcaactttcatgacttattaaaaattaagaaattttcacaaaagtggatgaaattttttttgctctcatcgtttggataaatgagagttggttttcacgttttcccttttgaaacattttgtgactgaaatacccttaatagaatcaaccaatcgcacagttgcagttggttttggtttagttttttttgcagtttggttttgcgaaaaaaaaaaaaaaaactgaaacgaagaaaacgagaaagagacggagagatccgagagaaaagtagaaataatttcgaaattcattcatccactccttcatttttcgacattaccgttcaaattgttgggtaattgatttgaggcatcctattgaactttaaaattgagaaacaaatttcatgttttcagagatgaacaaaatacaaaaaaaaccaaaaattcaaacactttagcttttaaaactaaaaatactctaggtttacaagatttatttgtaaaaagtattcaaaatgaaaaaaaaaatgagattttgaaaaaactggtaaagacggccgcaaaattaggtttgcaaaaaaggatacagaggttgaagatgactgaaaaattacagttataaccttcatcgaatttcttttgtgtacgtatattcaatttacaatgtacgtacacgaacttatttagtggaacgtatatggtacgatttctaataacttaagctattttattacatattcttatatctcaataatctccatacatacataataattaaataaaaatatatggtgaaataatatttgttcctcatattgaaaaattatgtacgtatatgtgcaataatgtacgtacatttttgttggtaaattaatgtatgtacatgtgtagtaatatacgtacatctttgtttgtgaattaaattattaagaaaaatttattgattcaataataaaccgatattgacaatgactgagatatattctaagactttcatacgatgtgattttgaaacattctgaattcctgacgacttgagcagtcaaatgtcatggacaggtatcatcaacgcatactatctccaatcttgtaggacatgacctaggttgcttatagcaaaaacattgtttgattgcgagataagacattgtttgttgtatgacttttctgttcttaaaaatactcctcaatctatagtgtacgtacattggtacaaaccatgttgacacgtacttcttggagtcacagctggtgtacggtcacccgagtgagaaatgttatctttgttaggtacacgctgacttgtgtacgtacacgctgccaacagccgactgaattcccctggacgttgaacagtcagttgagtgaaaatgaagtcctcctcaacattccctattccatattcttctacaattacatcgttccacttgttgtaatcataatcttcgccactactttcactaccatcgatagtaggatcgagggtacttctcccatagatccatagtcaccctgataatcatcatacccatcaccattttcgttgtccccctcctattcatcttcatctgttttaccgtcttcaacgtcgtcttgctcatctagcgcctcattattttcatcaacatttgaaacactatcacacacatggtcactttcagcatcgtcaccatgagtcctagagacattatttccgagtgtcttgacggttgtaatgaaagagacaaacaagttaagaaaaagatacccaccacgaatcaaaaagaacgtatctaaccccacttgactgtcaatgtagacaggagggcgtttagtatctatcatcactgacatctctcccggcatccagtaactaattatgggattgatctctgcggacttcaaactgaaagcctcgcttagtgtacgtcatattttccttaacacgtacacatcgaccaaacatgtcttcctctggttcaaatttccattcttcttctttgcatctccactcaccgaccatagtaaatacgggaatatccattacccaactgcatcataaattcaggagaaacccattaaatgcaactgaaaacatgattatatctacaaaaacaaatagaatttcgatatacacacttataaacataaatatctactcatttagcattttcaaccaacaaaataggaaataaaagatttctgggtttttctataaaaaacaaagttgatttcgaatacaatgaagatcatagtgtgttataacaaaaaacttcttaaaaccttcattagttacacgataatgcttgtcttggctccaaacttcgtaaataaacaagatcaacccttcttcagcatcacattccttcgtaaaataaattttgtttctgggttcatctttaattcaacaattattatctcaaatattaatccaaagtaataatgattttgcattaattgtgacaagagtcacgtctaaactttttgggcattaaatattgatggcaaattgtttttcaatgttagtaagccccccttttaactgtacaaccgcacaaatcaatgtttctccaaaatatctttaaccaaaccggaatagtgtacctaactaaatcgtctaacttaaccgtacattcaaacaatatctagttacgctggtaagggtaaaatggtcaaatttcagctgaaaagataaaacatgaaaactacctttgactttgccaatctctgaaaataaaacatagtcaaagggtgtgacctgcaaattaccttacaaattctccttctcctttttttttttttaatatctgaaaattcaagtccaaagactctattttttcccgaggcgggatctacagtaggttaaactcatctcttttagataagagatctctttcaacatgcctcgaaccctacacctccacttgagagatttaccattggactaaccgcacgttagaaaaaattcaaattctcgtttaacaatgcgttgaagacaaaaagtctatacgggataaaaaactatttaaaatgaaaaaataaatcattaaaaaaaaggatatcttagatcaacatcacaatttttttatttagatttgattatcaattttcttttttaaaatcacctcatcagaatttatcaagaaacaattttagctaggtcacctctaataagtgaaatcattaaacaacgatataaacaattatgaaagtgttactccaaaattttattgtaacaagtactagctattacaattaaattttaagaatatgctaccacacctagtcaagtcaactagtacccatttctcacgtcacatattaacatgcaatgacgggttataaattaatctatcctataatgagaggaaaaaaaaaccattttaacaaccttatcaatttgtgtaaatgggaaagagttgtgttgtgactagttccttctcgcttctccttctcttccttcaaaccctaaaatatgttcatgccggtttcatttgctacggcgactttttcaatgttaactacggcgtcagtcgaacgtatctcttctcttctcttccttctaacgtcgtttctaacggcggtttctacaacgcatcgtttggcagagattccaaaaacaacagagtccacgttgttgccttatgcagacgaggctacgagaagcaagcttgtaagacatgtctcgaacatgtgattgaagacacaaaatccaagtgtcctcgccaaaaagagtctttctcgtgggtcactgatgaattcgacgacgtttcttgctctctacgttacaccaaccactcaactcttggcaaactcgagctcttaccaaatactattaaccctaaccctaacagtatagattccaaattcaacaacatggccatgttcagccaagaatggattgcaatggttaaccggacactcgaggctgcttccaccgctgagaattcctcagtccttaagtactacagcgcaacaagaacagagttcacacaaatttcagatgtttacgcgttgatgcagtgcgtgcctgatctatcgccaggcaactgcaagagatgtcttagagagtgtgtgaatgactttcagaagcagttttggggaagacaaggaggtggggttagtcggcctagctgttatttccggtgggatctttatccgtactacagagcttttgacaatgttgtaagagttcctgctcctcctcctcaagcttcttctactattatcgattacgggagagacgagaaaagttttcaaggaagcaacatagcaattattgtggtcccttcagtcatcaatctcatcatatttgtggttctaatattctcttggaagagaaagcagtcacacaccataatcaatggtaaagtcttttaaaataagcaacatatatattccttatcttactaagagtttggttttaaacttgacatgttttatttgatgacgtgcagatgtttttgattcaaataatggtcaatctatgttacgttttgatcttcgaatgattgtaactgcaaccaataacttctctcttgaaaataagcttggccaaggtggatttggatctgtctacaaggtaaagaaactagtaagaagagtcctaacaaaatcttaagatgggtcagtgatctttaattatagcatgagaattcgttttcagggaatattaccaagcgggcaagagatagcggtaaagagattaagaaaaggttcaggacaaggaggtatggagttcaagaacgaggtcttactcttgacaagactccaacataggaatctggttaagcttcttgggttttgtaatgaaaaagatgaagagattcttgtctacgagtttgtccccaattcaagccttgaccacttcatattcggtgagccttcgcgagacgagactttgcatctttgcatgttacactacttttagaaaacaagaaaaaaaaactgtttctttgagatgtgcagatgaagaaaaacgccgagttctgacatgggatgtgaggtatacaatcatagaaggagttgcaagagggcttctttatctccatgaagattctcagttgaggattatacacagagatttgaaggcaagcaatatccttttagacgcggagatgaaccctaaggttgcagattttgggatggcaaggctgttcgatatggacgagactcgaggacagacaagcagagtagttggaacatagtaagtaagctctgtttttatttttaaagattctttgatcagcatcactattaatatgatttggttaatgcagtggatatatggctccagaatacgcgacatacggacaattctcgacaaaatctgatgtttatagctttggtgtcatgcttctagagatgataagtggtaaaagcaacaaaaagttggaaaaagaagaagaggaagaagaagaagagcttccagcttttgtaagcttatcacttatgtcgatcatctttactcttcttcttcatcttcttatcgaaattttaaaaattatttgcaggtgtggaagaggtggattgaaggaagatttgcagagatcattgatcctttggctgctccgagtaacaatatctcaataaacgaagtaatgaagctcattcacataggtttgttgtgtgttcaagaggatatttccaaaagacctagcattaattcaatcctcttttggcttgagagacacgctactatcacaatgcctgtgcccacgcctgttgcttatcttacgcgaccatcgttatcacttggtcattaatgaaccgtcaatcatgtatgttttatacctatttgtctctctctgtacaatgaatgacaaatgttgagaaaagagatgccgtgtaatgtaagcaaacttatgtttgatttgtgctaaacttatttatattaaatgaatatttgatatagccagcgttttggataatgttggaaattggactgaaacggaggaacgcatagatgaaattaaagtccaatttctatgaaagttcacacgagcagaaacaaaaactttgatctaatgtaagaggaaatgcgtgcggtaggggttgcgtagtcataaagaaaggacattgaacaaaggcacatttttaaacttatatgtaagagcatcatgggctcttaaccatatttagaatttaaatattgcacaatcaaaatacccctcatgagtttttatttttgacaactccaatggtagaagttctaatgaggctcttaaaatttaaatttttgaaatttatatgtgtttgtgtaacaccccgatttcaggaatatggtggtgcatacggtgaaatttaaaataattgatttgaccatttatattaccaaaatgcatttatcttttcgatcaaagatgttgaaaatgctcaagtaaataacatttgacattatattttacttttttcatgtttacaataaagcttcgttttgtatgatctgaaatataaaattttctctatatttataaccaatttactatagactaaatatttttaaattacaaataccgaatgactaatccataaaactgtgatggacaccatatataaagctatattggacgattgtgggtgttgttcattaaattgatgatttccactatgtcaaacctttcctccaaatttaagaatgacaaactatccaaaattattttcaaagatttttgaaagactcactacgagtttctcagaaattaacaattgttacaattttcacttcttttttcttcctgaattgtcacattctttatacagtatatgagtatgactcgtagaccaagcaaaggaagacttttttggtcatgcatgcgaccaaaaacaagtacttacataaccatattgaaaggacaatattttcaatacttctagagaagaaaaaaacccttagttcatacgaagtgattaagaaatgtttaccctttctctacggctatttgaatttgaatggccatctttgaagtcaaccattactcaaattttttcatgtgtactcaaccaaaacccattctctctcatgtcacctaattatacacatatataaacatttattacctcattaacaaaaaaaaaaacaatgaacaaaaccctaaactccattgcttaacaatgataatgaagaactctgctgcgatcttccttacttcttcccttattcttctccttcaaaccctccacggagttaaagccggtttcatctgcgtcggaagctccttccccaccaacagtagctaccaaaaaaaccgtgactctctcttctctactctttctgataaagtcaccacaaacggtggattctacaatgcttcactcgatggagttcacgttgttggcctctgtagaagagactacgatcggcaaggttgtatcaactgcgtagaagaatccattcgacagattaaaacaagttgttctaatcgtgttcagtcgttccattgcaatagtgacgatagagaacgtgtttcttgtcttgtacgtaccacggatcaatcaacttatcggatactcgagcttggaccagctacgaatgacccgagtcctgttgctatcgacacattcgcaaagaacatgacccttttccgccaagaatgggaagcaatggttgaccggacgctcgaggctgtaaccattgacaattccacaacggttctcaagtattacggtgctctcaaatcagagttcagtgagtttccaaatgtatatatgatgatgcaatgcacacccgacataaattcaggcgcgtgcaagagatgtttgcaagcgtccgttacatattttagagaccagaattggggcagacaaggaggcgggatttgtcgaccgagctgtgttttcaggtgggagttttatcccttttacggcgcttttgctaatgtaacaagagttccagcgcctcctcgagctttgattcctcgaacagaagcaatctccatcactcgcttgaaaggtgtgaaaacaaatgagttgtttaacattttcacctgtgaaattatctgagattctcatacaaatattaaaaaagagaagccataatcttgcaggaggaattatcgcaatatttgtggttcctatcgtcattaatcttctcgtctttatcggtctgatcagagcatatactcgaataagaaaatcgtacaacggaatcaatggtatgttgtcagggtttgcaataaatatttgtgatgcatcattgctcatagtttttttttttttttggtatgtgcagaggcgcaatatgattatggtggtcagtctaagctacggttcgattttcgcatgatcctaacggcaaccgatgatttttcctttgaaaataagattggccaaggtggatttggatctgtctacaaggtaaataaacttgagaaaaattactatcaaattctttagatgtgtaagcaatcttatagcacgataatcgggtttgcaggggaaattaccgggaggggaagagatagcggtaaaaagattaacaagaggctcaggacaaggagagatagagtttagaaacgaggtcttactcttgacaagactccaacataggaatctagttaagcttcttggattttgtaatgaaggcgatgaagagattcttgtttacgagtttgtccccaattcaagcctcgaccacttcatatttggtgagccttttttcactttgatgtttgtgtaaaaatttttgaatgttctagtcgctggttcgagtgacacttgggagatgaccatataaaaatattcagtggtttagtatattgatgcttctttggtaatatgcagatgaagagaagcgtttgcttctaacgtgggacatgagagccagaattatagaaggcgttgcgcgaggtcttgtttatttacacgaagattctcagctgaggataattcaccgagacttgaaagcaagcaatatccttttagatgcatatatgaaccctaaagttgcagactttgggatggcgaggttgttcaacatggaccagactcgagcagtgacaagaaaagtagttggaaccttgtaagtatcctctgtttttactgattcttttagacaaaacaagatactctgtttttttttaccctaaattttcgagattcttggaatcagaaactaatttgaatttgttttagtggctatatggctcccgagtacgttaggaacagaacattttcagtcaagacagacgtttacagcttcggagtcgtgcttctcgagatgataaccggtcgaagtaacaagaactatttcgaagccctcgggctccctgcatatgtaagcaaaatccagtcttgtttactactttagacacaaatgaatctcaaaagataatttgagtataaacttatggtgataatatataggcatggaagtgttgggttgcgggcgaggcagcgagtatcatcgatcatgtcctcagtaggagccgaagcaacgaaatcatgagattcatccacattggtttgttgtgtgttcaagagaatgtttcaaaaagaccaaccatgagtttggttattcaatggcttggaagtgagactatcgccattcctttacctacagttgctggttttacgaatgcatcgtatcaagctgaacatgaagctggtacattatcactaaatgagctttcaatcaccgagttaagtcctcgttgaaaccaagatctctctgtcaactcttatatccaagttttattcacctaaatttcacgatataaacatatgcacaataaattaagttgttattcacctaaatttcaatttctgaccaaggagatggaagatatgagaagcatatgacagtttggtttgcaacaagataaggagggtagttactactaaatatttttcagtgtatgtatttttaaaaacgttaaactttccgatgcacttgatgtaaacacgttttttcgaataaattttacattctattcaaaaaaaaaatttcaatttctgatcatgggctgaccattggacaagttttcagaccatgtccattaaggaccaacaattaaaacccatgaaaaataatggtccaagtggacatgaccgttgggttttagacagtccaattgacacttctacatatatgtatgtatctaaatggggttccaactcgaaactcattatcaataagtggattggtttatgtctcttatatactgttcaagtctcttcttttcttcccagcattccaatgtgagatatttctccacatctactaaaatggatacataacataacaataattcaaaatattccttctatacttgagagtaaagaatcttggtcttccatgatacttccacgcttcttctttattttgttagggttttaaatttatatgctaaaacaagtgttcaaaaaaatgctaggcgctaatcgggcagtgatccaatgcctagcgtctagaacgcttaattgaagcctatatgattttaggcggttaaagcgtttatagcctaaaacattatatatatatatattattatagataaaaataatttaaaatatgcattaataaaataaaaatattaaatttataaacaaaaattagataaaacgtacatttaagagaatcttgcaaaacctgccatattcccctcaaaatcttacaatccctatcatattcacagtcagcttacagaatctaccacatttagctacacgtggaaattcgtggacgaaattacccttaaggtgggtcagtgctctgacttagatggcgacagcttcgtccagcgaaaagaggcagcccctgttccgtaataaatgtttccgtttccgattggatgttatgtggatttattttttaaaaatggtaatataggggttagtcactttaattgtttattaatgttgcagaggaaagatgttgtgttgaacagaacaaagtggtaaactggggaatttgggaggtgttgttgaagacacaaccatttattgcggacgaggtaaaatttattatctggaatttctgtccttcgattcgctttagtttggtagttctatttgtttgtttggttgtgataaatgcaactacctcatattccaaaatggtatatttgttctgtttgaagaacagaaaaggatggacgaaggagttatggtattggtcggtggctgggaatgcaaagacaatggggagtggcgtttcaagatgtcggataataagtacgggaagtgggttgacgtaagcgaatgagatatgttgactgaaattgtatcaaaagttgcaacaacgtttggactagacaggaagaccaaatttcagctgagtttttggttcgaaggaggagacactgtctacacgcatcagaaaatgtcgcctgtctctgttgacaacgaaagctcgttgaagaaattcaaagagaaaaggcaagaaaaaggaggtttgaacatgtatctatctatagacgatgtcgacgtggctgagatttcgtcccctgaaataaggggacacaaagacaataatgttgtagaggtagaagtggcgggatacatgggcgggcgaatggatgatggtaatagcacgcatgcaattccattgacttatgaggaagacggcttcctagaagaaataattgtgtgtgaagaaacttaaagaggaaggctagtttactagagttggcctgcgcaaagcggggacgagaaaaggaagtggatgtagagttggcaactgagacaagaggatgggcatcagactcagaagacgaatcgttaagggaggtatcagattcagaggattatgattttgataatatgagggatatgattgatacagattacctgccggattgggatccttggaaggattggaggaacagcacattgacaagttttgacggttagccggggacacaaatgtgtggaacaactttgggggataagtcatctaggcccaataatatgggggacgatatactgctttgtggcgggggacaaagccgggttgaccttgtcgaagtggaagttattgagatgaacggaatgggcgatgagagtgcaaaatgtcgattcagctggggcaaagtagaatgagagctgaattaccggatacgcaagcgacaacattggaagaatcgttagacaaggactgtccaagatgtttggacaacgtgcatggacaaagcctgcaaggggtaggtatagtggacgttgaggttacaacaatcccagacgctgatgcacaaggtgatagtgagaatggaattgaggataatgatgaagaaaatacgagaatgtctatataattggggcagagggcagtcccaaatatgaggacagattcaatgacagagacgttggatacgtgtttggtccctgaatctggagaatatgtaggaccagtggacgttgtagtgacatcgttggaagcaagtgcatctgaagaggaaggacaaagtgatgtagaggttggtaatacaacagtgggggaaatgataatacagcaagggcactggcagaggacatgtcgagaagattaacagacggagagactatatttactgaattagcaggggacgagatgttgatgtgtagagatgccgttccgttcaaggacaacgcagccggggttgcttccgacaaagctaatatgaatcttaggaagggtggcgatgcaatatatatcgggtgggtattcaacaacaaagtcgagttgcataaaacattaactatgtactctatgaaaaggctattcaatttccgtataaaagcgtccgacaagacacgagtcattgcggtgtgcgatgataaaaagtgtgattggagggtatatgcaacgtttcacgagaattctgaaaaggtggaaattcgtacggcgactctaaagcatacttgtgatgtcgaggcgcggtctaagtatgggatgaaagcaacacgatcgatgttaggtgagttgcttaagacaaaatatacgcatggtaagaagggaccaagggcctgtgaactaccagaaatagtattggctgaactaccatacatgaaggcttggtacgcaaaagaaatagcaatgaaaaaagctcgtggtagtgaggaagaaggttataagtttttcgcagacatgtctccacctgttgaggacaactaatctaggtacgttgtccacagtccatacggattatacggaggaagggaatattcgtttcaaatatcttttttttttgcgtttgggcttcgattgttgggtaccagtatttgcggaaagttattgtgatagatggtgcacagaccaaagggaaatacaaaagctgcttagttgctgcaagtggacaagatgaaaattaccaaatattcccattagcgtttggtattatagacaatgaaaacatagcaggttggcagtggtttttcgaatagttgtcacagtttatccctgatgaggaagatctagttttcgtctctgacaggcatgcggccatttatgttgggcttaggacagttcactctcttgcgaagcatgcgtgttgcacagtacatttgttcaggaacgttgtccataatttccagtgtgagggacttgtaaaaatggtctccatggcagcgagatcttacactgtgggagatttacgatattggtttgaagaaatacagaagagaaacattcaatgtgccaagtatttagtagagataaagctatctcacaggacactggcgtacttcccgggtatgcgatacattgtgatgagaagcaatatctcggagtccctaaatgctgcaattcaaaaagccatagatttcccggtagtgaccatggtggaatttataaggacaatgttgatgcgttggttttgcgagagacgacaaactgcagctaaaacaaagacaagatgtacgccaaaaatcgaggatttgctaatagatcatcttaaattagccacagattgtgcggtcatagcagcagacgaatggatctatcaagtaaacgacagttttggcatgatttttactgttgaccttgagaaaaagacatgtacttgcagagtatttgatgtgctaatggtcccgtgttgtcacgctttagcagcggtgggtgtaaggaacgtggacatatactccttgatcggagactatgccttcgtgacagagtggcgtaaactatagcgtgaacatattctacccccgccaaaggaaaaggacacagaggtcccgaacgatattagtctagtggttgtatatccaccaaatacaagaagaccagttgggagaccaaggaccgttcagataccatcgaggggggagccggtaaataactaaactcttagcatagttttaagtcctccgaatctatcataaccaaacgtgtcatctacttgtagggcaaaggatggaaaaagaagaagacaagacaatgcagcacatgtgggaaggatggccacaacagaggctgggggaaaaagtgcatcgagcgcgtgttaacgtttttttgtagtttttgatgtttcgaaaagacgttttttggtccatataagtttttggttttggtctccagattttaatacagatcgggggtgtctttcgggaaggggatgtaattcagtcgaacgattgctttttgtaatgttaacttatgatgttgactaccaactagtttattgtaattgctacatatagaacaataattattatattagacagtggaagagtaaaaacgcagaaagatgcattaaaagtgctggaagcaaagtaaacgtgaagactgaaagcgctggaagataatcacagtacccaccaatcaatacaaagaggacaggggttgcaataattgcatttcttatattctgagtatcgacgagggggatcaatcatgtaacacggccagcttatccagttcaagccaagttagtgtggcgcaattatattgatattggacataacactcatagccacacaatcggcgttgcggcaagagacaacattgagtttaaatagattcatggcggtaatggcatcatttggtctattaaccgcaatatggtagagacccttcgtaaaaagtattttgggggacggatcgggtatataggcgatcatgtccattgcttctttgattaacctttcaaatgaagccagcctaatgctctctaagtagcaagcaaccggattaccagcctttacacatcgtaacagaacaagtaaatgggtgaaccactggagactaattgagaatgcgcttcaatgagggccagggatgtctcccgcgaaacggatggatcaagtgctagacgcaagccagcgttgccagagacaatgaggggacctaagtgttggtaagataactttccaacaagaaggacaattgaaaccctaagatgttgaggaagcgattgccagtttaccaaattgtgatgtttgaagtatggtttagtttggatttcacacagaaagaagaactatatatatagttgggattaaaggagaaaataaaatggatgcaattagtaggtatggacaatgaatattagatgtgacaaaaagctataaaagctacaccattaggacaaagcaaactctgcaaagtacaaaatttaattaaacggtttatagaatttagaatattagttgaggaccataaatatgaaaactaaatgaatgatgaagtgacaagacaattagccattattaggcaaatggggacatggaaaagtaaatatatagactaaatattgaaaaatcataaaacgaaatatataaaaaacttatcaaatccgaaaaaaatggacacatactcatatggtccacatcttacagtacggttacataattagtggacaaaataatcaaagataaaacaatagttctgtggaaagaaaaagatttaatagagctctagcaatgaaattatcgctacatataagtgccaaggacgaaagcgacaatggggacaaggatcacgaggacgagaattatatgcgggggacaagaatggacttggtcgatgatggtacgaggggagcgttcgagaagaccaacttgatgctgaagagatttgatttcttgctggtagaggtctaggcgatcccacatgtacggaggatcaatgcgttcaccattagacccggtaactacgaacttaatgtgttcatcctgttccctgacagagcacttgagcgctgcaatcttgtccaccaatgactcgtccaaccatttgacaagatgacgcccaggtcgggccttgaaaaagatagcaaaagcaggttttatacgtgtggagatagaaatgaaaaatgggggttaatgggcatacctctctcttctcgcactggtagaactgtctgttgtcctcagaggacgaactcgcaagaaccacaatcccaccacaataacagcgacgtggaataccaagaatgggcgtcgacggttgggaagggtaaactagtccatatgacgtcggagattctgaatgctgagaagattccgatggttgtgtataactatgaaggcccatgttacagtggctgtggataattttgaacaagttaaaaggaaagtgaataattaatggggttggaaaattgagaaagtggacaagttatccttcaaaaggtttgaaagatttgaaggataattaatttagagagataaaaggggggggggagaatttagagagataaaaggccggggggggggggggaagaagaacttcagtaacctaggcacctaataatataataatgttaaaaatattaagttgatgtgatgtgacataaaggtaaaatcatagaaaagcgtaagggataaagattagtagaaaaaattgtggagacagttgactgagactgttcttagtgggaagataccccacaatagtccacgaatgtgaagtgtattgcatttgcatacttacaaagccacaacataattgttgtcccctctaaatatataatgtccctccccatccgttgataagtgattttacctccacataaaatattttacataaagataagagttatatatggaataaaaggtagtaaaaagttaagtctccaaaaaacatacaagttcggaataaaagtagagtcactaaatattaaaacagacataaattctaacatggacatcaaacacgaagagcttcaataaactcctcatagatgtctacagcaaatctcatcctgagatcttcaacggactcctcagttatggagtcatggctaatggcctgaaaatgaagctcaataaacttcacaacaagcgggccactgtcatctgcatgctcagtttggaagacctcagggagacgatcataagcaaactcaaggggcacttcatttgtcctcaggtcttgggggacaagcgactttataataagcggaatcaggacaataaaaggtttcatcaaaaccgtccatctgtttggcagtcttcgagtcagcgatagggtctagcacacctatggtaccctctttctgatttatgacaatggaaacgcagtgaccggcagtgagatgtaaaggagtgtacaagatgtcgacatcagcgaaccaagcctatcggatgctacggccagggacgatacctttcacatagtcccagatcttactgttccacgaccagtcagatttacttttggccttcttataacgtggatagagctcaacaaagttaagtgcgaacgaagaatctagtataacagccatactctgtaccaactcatcgccatacctccgcgccaacaggcttagcatagcctcgatgtattggattacataaagacaaccagttagatctgagtaaattttaacatattcccaggtttagcattgatttggtacatacctcctggtggacagcagcctgaggagtgtgcatgtccttgaaaaatgttttagggacaacatgtccctcgataacgtacttcctgaccattcattcataataatgattaatagatacgtagaagaatattagttaccaaaacaataattcagcggaaaacttaattacctttggcgataagctttgatagtggacaaaaagcttttccgaacctcatcgtttactttggcaattgggtgcaaatcatcatggggccctttgactactgagacagtaactgtctcacaaaaacgctggggttttttcttgcccttctgggaggaagcatagacttagaagtatccccttctccaacctctctttttcttttaatcctagagggaaaagtctctgaaattgggacaccagcatgtgcattaccctataagacaaagatttatgtcagatccataaaagacaacaaaagattgaaaaaacatagatttatacctcttgatcggatagttgttcagtatcaacttttgaggattgaagaagctcttctggatgtatagcaacagtaataacaaaaggtttgctaatcgcaataaaagatataataaggattaaatgaggaatacttcgttcatggtctgatcatcttgttgatcaccggagtcagaccttccttcactctcatcatcaccctcgtccccttgttttggatctccatccccttgatgagtatcatcaccctcgtcccctcgttggggatctttgtcccctggattagtatcatcaccctcgtccttttatttgggatcttcgtccccttgaagagaatcatcaccctcgtcctcttggtttgctccgtcatcaaaatcgtctccggattcagagtcactaactaagacagcctcatcttgaggcgttaggaaatcgttgggctacaagtaaaaagaaagaattaaaggtaaataagattctcaagaccaaaataattatttataaaaaaaaacacaactatctagaaacttacgttgtgatcttcagtaatattcacattatcagacttcccatccatttcctatttaaaaatgttatgcaaacatttacaatgttatatgataccaaaaaagaaataaagggacaatactcacctcgtctccaatagcagcgtctccaagagcagcgtcctggtcttccgcttctgtgtcctctggtatggtctgcagcggcgtttgaaagtcttttggctaaataagaagtaagcacaattggttaaagtaaaaggaaattctaacgataagtaatagatgccaaaccattaaacttacattgtgatcactcgaggatttcgaggacgatggaccaccagaaggatccgaacaagtagaaccaaactttccagcctgcggaggaccagaggaagatgcatgagattggttgatgttcttaataacttcagacaatcccccataattagaccaggcttgctgctgcaatgcattcaagagttgagcatgagtctgtccacttggggcagggttcttgcttgacgaatcagcgattcgcgagggcatattactttgtctctcagggacaatcttggggtcgaggttcttcgcggggtcactaatttgtccctcatctgctatgtccttttgggacgcagccttagggggtggagtgacaattccatcaccactagtggactttggagactttccaccagatttgggacttggaaacttgtcaccatggcgcaaattgcttattatctcgtctaatagttcgtcctttaacaaagaattctctaagataaacataccagtaaggtccccaaataattcaaccttcagttcatccttcaattcacgaaatttagaattaacctgttccatgatcagaccatggagaatatcatgtccatcagtcctcggtggtggagtactgaactcttcatgcaccttccctttacctttagcagagggcccttttggggaccagatggaccagcctggaaagaatcagggatatccgatggtctgtgtggaggcaccttctttgcctttcgagcattgtcttctttaggatggttctcatcaacgacgatctttggccaggttcgacaaccacctctccagtcagattgttggaacttgtatcggctaccaatgaccctttccatatagtcaagcgtcgggtcttcaacttcatcgatccagtagtcgttgatatttgggtatggtggatcatcaatgggcaacaacggagaaatactcaactacattgaagccgaaacaatttatcaactaaacaaatcatcaaaggcaaactagtgagagactaataagaatctaataaaattaggtccacagattaccctaggaattagctctgtctccattatgttggagttgtggtaagtcttcaacggaggcaaactggtgagagacgtctcactgatagtctgcgtatcatcggggtttggaaggtatctttccaattcagggataacgttaaagacaaaaagttggaagacaagagggaatccatgtgttgaattgttagactgattgaacttcgtgattagtcctgggagattgctgaccttggatctaactttgtgagaaggaaggactctcgtccccagggatacgcctcaaaagcctccaagtccttcaccatttcaacgacttatttagaaacttttacaggttgggaactacagatcaagatcccctcaacaataactataacagcgagacaaagccttctccaaggttccatcctctcttctttaggcttcagcttatctgtcttcaaccatttgaatatatccttgatgaggacgactttgtgttccttacctattaggacattccagtaaggatgtctcagatttatgggttgctgcgacttcaatatgtctctccgagaggggtaaggaccacaattcaaaccactaagaatggcaaactcccttaacaaaaaccggaagggctgaccggcaaaaacaaaccaaatctcgtgttttttccttgtgtagaggcctctacacaacatctggtggaccagtttcccggagaaagaacatttacggacttcaaattgaaaaaagggactaaaacaaggggcgcaaatgtagtttaactccttcgtcccatctagaatatcgacgagataaagaaggtacttaggcttagagtatgtatttatacgcccattcagcggatagcagtcagttgcgtaaagtctcttgggaagtctttcccgattgaattcagggatgcgaggaattattggcggatcagagctctgctcagcggttgatttggcagagagaaatggatcgtcgtcgtcttcaaaggacaccgaccgcctggcaccgccaagcgctgacttctgtttcgctttgctggtggaagacctcatctgcgttggggtaaaatcaaacaattatcaaatcagttattcgatgtgataaaataattaaacacacaggaggacgaaaaaccctaaaagctgtaatgggggacatttcgattaatcggaacaaactcaatcaaccggcttaattgctaaaggttttcgaactttctgggtaaatgaatcgcacaggagaggacgaactatctaaaatcataatgggagacaaactcgatttttcataacagaccagtaacaagggatttgctaaagattttccaaaaatacttcactgaataaaatatgaagacatgattgaagatagcaacatgcagaaacttgaaatgaccttaccggagacataatccgatgaaagttatcggtgaaggaaagggaaagtatgagagagatagacgaaagagagagagttaactgttgttgtttttccgcacggtttacaatgaaaaagagataaaaggtattgtaaaaagacgcagttgttgagcgcgaaaactgctcagtaaaccgtgggaacaaaatggacatttcacaaccaaatgtggtatgagttgtaatgcccgaagaaatatggcagattacataacgattgggaaaaatatggcagattttataattttcctacatttaattcatatcaaacaacatttgaacatttaaaaccatatacatttgaacatttaaaaccattcaacgagaaatcataataaagccatcatctgaacagtgccaccgaattagtgtttctactttatccccatcaactcaatccaatcattcactatgacaaattttggattccgattcttaaaagaagaaaaaaaatctaggttaagtttcgacgtgccgcgcgttaatgaacagacaagaaacaatttaacatgtcaatcttcactaaaatttactttcggattcgagacaaacctgagagaagcgaaacagatcaaagcttgctcgggaggaatggacgagaggttgaagaagcggtagcggcagcgcaaataaacgaagaattacaacaatcaacgtagaacaaacaaggactttcagaaaaggctcataaataaactttttaatggaccatattgtgtggtaagaagataaatatatcttatcaaataaaatataaatttactaaaacattataacacaactatacttatttattttatagaaaagaaattaaaagtaaagaaaataattataaaaaaaatgtatatatcttattaaataaaaataggaataaaggtagagaaatttggatctataaccaaaaaaatttaataattaagaaactaacctaaaaaaaaaagctgttgtgatattttttgtattttgtatattaagaccactttacccttctcacctctcacctctcacctctcacctcttatctctggcatctcatctctttttttctatatcgccttcattaaaacagaacaaaactatagttttctattttactttcaattttgttacattctatttgctagaactaaggaaaacaaatacgaagactcaccagatctaattgaatattttctggtttgatcaatatctccttaacacaaatttaaacccaaaatcgaatcgatttcaattcgatttaagaaaggagaaaagagattaagagtatataaacatgattttttcagacttctaaaaactgaaacttgagatgatttcatttagtttaattatttttgtttgggttcatataaagtatcatccttagggtttaatttttttaaatcaatagatgtttgtaattagaatggattgagataaaaaaaagttaatttttctggaaattttttattgaattggggagaagagaagaagcaacgaagaagatgatgaaggaaaaaggtctgttaaataagaataaagtggatatttcccagttctcatatgttagtttcttaatttctagaattatagtgctattttcttaatttagtgttgaaaactagttagttttccaattcacccataaaagtattttcagaaaaaaaatatagaaaaaaagaaaaaaagtattagtgtacttggaacctaatattattcattatcaatcatggaatttttactttacaccgaagtcgaaactctactctggacgataaagtgtatgattggtgccgacaaccaagatgtagccttttttatatactgttcagacctggtgaagatagttttttcctcaaccgaatagtcggcgttttcagcatatttggaggattttcagagcgacaaggaagaattcacaagcttctctttatctttaattttttgtaatgcaaatgttaaaacggacaatttggcacgaaaatttgtactaaatcgttttatgtcacttatgtaaacaatattccgcaagattgattcttttgagctcaaaacaaaaccgatgacaaaaaaaaaaaaaatcatggaatttctaagaaccgtagacacttacttggtcaccgttgccaactacgacgaaatatttataacatttctaatatgctacttgacaaaacaaaaaaggctacttgaaaatcgctaatttttgtttttcttcctcactagtcaatatcacttatgaaaagttatttgtaaatttgcaattactttccaaagtaaggttttgtgagtaaaatgtatgttttgataggaataaacattctcaatttactaagcagttatgtatactatagttgttttaaacgcacaaatgaaaacttgtcaaatgggattgataacaaacatatcatactactttctttctatcttttgtcaatatcgtattactttatgttaaatatatagtaaaacttctcgataaattaataactatataaattaataaattcttccgttccgagttgagatcaatgtaaaaattgatacaaatcaatatattaataagataataatttttttgaaaatcttatataaatatatggtctcatttaccttttagattaaatttttgtaaaaagttacaaaatttgtaaaatctctctataatttaaatttattaattaatcgataaattaatacctttttaaattaataaattttctcggtttcagtattattaatttatagaggttttaccgtatttcaattatatcctaactatacaacgaaaacacataaaataataaaatttgaacatgaacatctctgtatacatatatggacatgagaacctacgcgtatgtccgagtactttcctagtagtaacaaaatctgaccaatacaccattttgtcaagtcaagtagtgtgtactcgttgtctcaagtcaccttataatatacaaaagctctatagtaattgattatcctcgtaacaataacgtatgatcaaaaagatatggggaaatactctgttttgatgatctttatcgcttcttctcttcttattgtccttcaaaacgtggaaatcgttaacgccgtcggatgtaccggaagcttcttcaacggtaatagcagctacgctcagaatcgccgcgatctcttctctactcttcctaataaagtcgtcaccaacggtggattctacaactcttcactcggcaaaagtcccaacatagttcatgctgttgctctctgcggaagaggatacgagcaacaagcttgtatcaggtgtgtcgacagtgcgatacagggtatactaacgacaacgagttgtctaaaccgcgtggattcattcacgtgggacaaagacgaggaagacaatgtttcttgtcttgtaagtacctcaaaccactcaacttttgggaacctcgagcttagaccttctgttagataccaaagtccgaatagtatcgagccatcgaaaaacatgactcttttcgaacaagaatggaatgcaatggctaatcggaccgtcgagtctgccacagaagctgaaacttcctcggtacttaagtactatagtgccgaaaaagccgagttcacagagtttccaaatgtttacatgctgatgcaatgcacacccgacataacttcccaagattgcaaaacatgtctgggagaatgcgtgacgcttttcaaagaacaggtttggggaagacaaggaggcgaggtttatcgtccgagctgttttttcaggtgggatctatatgctttccatggtgcttttgataatgtaacaagagttcctgcgcctcctcgacctcaagctcagggaaacgagagctctataacaaaaaagaaaggtaaaacattgatttgagtcttatttaagtttgttagtatgataaagatgttcttaggctaaaaggggtttgatgatttttaggaagaagcattggatatggtggaattattgcaatagttgtggttcttactttcattaatattttggtgtttattggctatatcaaagtctatggacgtaggaaagaatcatacaacaaaatcaatggtaagtgtacattatttcttgcttcaatcaaccacatgatgtagagagtaagtcttatatcttcttgttttttcttttagttggaagtgcagagtactctgattctgatggtcaattcatgttacggtttgatcttggtatggtcttagcggctaccgatgaattctcatcggaaaatacgcttggccaaggtggatttggtacggtctataaggtagtactaacatttgttttactaattatgagttcttgattgatcttgatctttggtgaataacaaatcttgtggaccggtttcaggggacattactaaacgggcaagaggtagcggtgaagaggttaacaaaaggttcaggacaaggagatatagagttcaagaatgaggtttcgctattgacaagactccagcataggaatctagttaagcttcttggattttgtaatgaaggagatgaacagattcttgtttacgagttcgttcccaattcaagtcttgatcactttatcttcggtgagacttcgaaagacagctgccaatttggatggttttagaacttttagcaaactaaatgtttctttgaactttgcagatgatgagaagcgttcacttcttacatgggagatgagatacagaattatagaaggcattgctcgaggtcttctttatcttcatgaagactcgcagctaaagattattcaccgagacttgaaggcaagcaacatacttttagacgcagagatgaaccctaaagttgcagatttcgggacagcgaggttgttcgactccgatgagactcgagctgaaacaaaaagaatagctggaacccggtaagaaatatatcaaggtatatttaaatgctctgttttgaaaacagagtccatgaattaatgttattggtttgcatatatgcagtggatatatggctcctgaatacttgaatcatggacaaatctcagctaaatctgacgtttatagcttcggtgttatgcttctagagatgattagtggtgaaagaaacaatagcttcgaaggagaaggacttgcagcttttgtaagcttcttcacatatatatatttttttgaataccaggaggttctgggccgaaaccacagcatgtaatattagtttcgtcccaagcgtcactcgaaccggcgacctctaagtttcttcacatatcagtttttgtttttctaatcttcaaaaacttttggtgtaggcatggaaaagatgggttgaaggaaagcctgagattataattgatccgttcttaatagagaaaccaagaaatgagatcataaagttgatccaaattggtttgttgtgtgttcaagagaatccaacaaagagaccaacaatgagctctgtaataatttggcttggtagtgagacaaatatcattcctttacctaaagctcctgctttcactggaagtcgatcccaatctgaaattggtgcaatgtcaatgagcgacgatgtcttcacggagttaagttgtcgttgaagttaatcagaatgttggttccaaaagggagttatcgttagttcaattagctaattcaaatgtgctttttaaagtatatgttgtgtatgtcatctaatagtaatacttttaggtattttgagtgaatgtaaggagatgaaaaaattgtatgaattatttatacatttttgttttaaaactaccacaaattgatattatagaggtaataaaataaaataaacttaaaatgttgcacagataaatataattgaaaaataaatagctgaaaatatatttttaaaccccagctagatttaaaatttatattttagagttagtatatataaaattttgcaaattatatctatttataagatatttctatttctcgtttataattgttattaagtaatagatatcacaagtccacgggttaattgttaaaatattgaaaatttaattcatattgaaacgacatgttagtgacatttaaaattttataaatattgattcaaacttgtctgttctgtaatataacccgtacgatgattttttaaccaatctcatgatttgttttctaaaagtagtaatttataaaatttaatgattatttattatatttgaaagcttacaaattgtatcatttctaagacattgatattttatagtttacaatagttatgtagtaaccgtatatcacgagacatttttggttttatacaatcttatataagttaggttgtttagatatatctaatattggtagtgttcttatatatcttactctgaacataaatattaaaattaatttttgttgataaaaatatattataaggaattttcggagtattttgacatcacttcctataaaggtatatatcaagtaactaatatagttctccctaatacttttcttctacttatatacctaaatgacgaccaaatatttcaaagttgatttcaattttatctgaccaataagaaatcttttctgactcgttttcttaaaaatattttttaaaaagagtgtctttctctctcaggcacggacatcgaagcacctcttccgttcacgtattccgatatcggcgtagcttttgttcgccggtgtcgagaaatatctagtttcacccttcatcactttgtttttaattttcttgtcttcattttcacgattttttcccccaatttgtttatttttcttcaaatttctccaactttctcgaactcactagatccatacgttttctcaataaccagcgaccaaggacaaaagtattttctggcgaactccctcctcctcgctttgctcgcaacctccttgacggcggaccagaagaccaccgccgaagactattttggatctggacttttgttcactcttggaaactcttcaacatggacttcgttgatggcaagagttctctctcttggaccatcagatgtgccattctcgatgtttttcgacgacgcatggtgattccttattcagagtgataaatccttctcaaaaacccatgttttatttgttcaccgcctccgccgcagataatgtcaatagctttctaccaacgaatcttattacattgaaggagcataattcatcgcaaatctatccttctgctttgatcaactgctgcactctctttccaccttggtcagcaatcacgaaattagggtttcacctaaagggatttgtccctagattcggcacattaacacgtgtgaagcccaagcccaacaacgttatattcaggtctgtttcaatttgtattttgacaatctttggtcgacattatgctcttgatggtcgacgactccatctcagaactaattcaccttcgttgatatagattaacaagtatcttttgagaactctggcttatgattcatctatggttgcgacctttgttcccaaatccaatttgttggatgaatgaatgttatcatggaaaatctatgcctaagtttccctctatgataataccatctaacaatttcaagtaccatccaacttccaccatgactaagtttcggatcatgttctttgaagaagattttgtttgtcacaagagagatctcgagtctctgagttgtgtcacaaagcaatctgtatccgactataaagccatagtctctcgaatcctagatgatgctctactccctatagagcttctcgtgccggcgagaatcacagctttgatttcttcatcaacatcactatgtcgatgcacactgaccaccatgttttccatcgatttgttcgtggaagatcgttcgactaaccgtgatctcacatgtgataaaacacaatctagtctttgtctcaaatctctcgtggaatcattgttgatttactttatctattttgttttgacattgaggaatgcctttctttttgttgtcttaaacgtttggagctttgccttttatcgccttgtagttggattatttgaatgagtgaataaatataagaggaatatttccttattaatcagataaagtatcaattcctaatttctgctactctacttgattcttattttactctacatagaaatataagaaagattttttttaagaaatacaatctaagcaattttccttactattttcactttaattctccaaagaaaaaaatatagaaatacatacctaatatagttcttccaaacatatttcttctaaatatacacctaaacaaaatctaatgcaaccaaatattttcaaagttgctttcaattttatatcatagatgatgtgatcatggaactcactattcgtatgtcgaattttgatctttctcgacttatcaaaaggcttttccgcatccttttgtggcgtcattcaatccatcatctcgtctttgagtcgtgtgtcgtatccatttcgagaatatccactccagatctttgaagtgccgaaattaggattgattcctcaccatgatcatatcaatagcaaacaaaattgttctacatctttttttttgggtcaaatgttctactacatttaagtaccttttttataacaacatttaaatagctcttttggtgacttatttgtgcttcaaagcaagcttgtttgttttatgtttgtaccattttgcgaccagtacataatatttagtagttttacgtttgtaccatttaacgacatgtacttacatcatataatagctatattggtttgtaccaaataaaatataaatattcttaggaaaagcaaaatcagcaatatattgagaacttgtaaaacataattaaataaatttctaaatatatttgtgtacccatataatggacgaaaaatcacattatagcatattataagaggactaccataatattttatttggtttttatttttctatctcattatgtatatgggataagcattaaataatatagagatcaagcattaaaaaaaaatagaaagcaaaattgtcttagtacttgcgcccaagagtgagttcaagggacaattcttcttcgccaattgcaccaccacaagcaacaacaacatcattatctctgtttttattaagtctcacctagaaaaagtatatatttatctagtttcatatgcctcaaatctacatgttgatgatcattcatgatactaatgtaagaaaaaaaagaagaagaagaaaaaatacacttgaagattgatagagagacttgttacttgatcccaaaactggagttatcttctcactaatatccaattgtaccctacaaaacaattgaaaaaaaaaattgttttatttaccaaatcaaaaatcgattatacaaaaacctaactcaatacatgaacataagaacctttgttgattttggataaattgggtagcatctcgagcactttcgtagatttgaatgtattgttgagattgcctcctgctcatttctcgcatcattctcctttctgccaaaggattgagcatgcataattataaatgaaaaggatataaagtcactatgcattatgttgaacatcaacatactaccatatacaacgttacactacaaacataattattaaatgttaatttaaatgtaagataattacttataccttttctagattcttctttcttcttgttcctatacatctaataaaagtaaaaaatatatatttatttcattacatactatcttaaatataaatatgatactctacattaatgcatatacatgttatgtatatagacgtatcttatatcgctaactgattatgtgtataaactataaagacctgaagatggcttttcacatgtgaaattgggaggtttttcacatccataaaatccaaaataaccttaggagttgcccctgcaaatttaaggagaatattgatattaattatagttaatctaaaagatgatatcaagaaaaatattatcatgtgtaatatataataataaaaaataagagagatgaggtatcttaaaggaaaaataggagattgtttattttaatggcgattggtttttctctcaatttatttagaagaattgtctttattttaattttgcgatatggaaaaaaattgcttacttctttcgccaccaagtaattcaacaacttgaataaaaaggagattaagatcatctgtccaacgccaatgcggcacttttgacctagtgtacgatctaacgatccgtcctctcattgttcttctgtctcttgtaaaactcttagtttgataaaactttagactacatactgataatttatataaaaatatatttatatattttccccaaaaataaccttaaaaaaaatatttagtgctagtacatgtttttgttgtcacgtgtaatttttgattttactattctctaaaaataaatataaaactgcattttaagaaataattatcttctgacaactccaaattttcttttctctaataataatatgcataataaattttaaaatctaaaatgaatacttaccagatttattttatttttattctaaaattaaatctatatatgctgaatatttgtaaaaataaagtaaaactcaaaaaaacaaacatattttctctaataatagccttgttattaattattattatttttaaccaaaggttataaataaatttataatcatccaaaaagaactttgaattatatttattttgaattaaaattagattttcttaaaaaaagctatgaatacaaatgagttgtaggtgatataaaatataaatgggagatgaaatcatttttcttatagaaatggagttacattgtagaatcgttgtttgtggaaaatgttcatcatatttgtatagagtactgcaagtagatgtgtccaaatagttaatcatattattggtaaaggtaaggctaaagattgtggaaccttgtttttcgtaaaatttatgaaggttgtttttgtggggaaaatatggtatgatgatgatgatgatgacggtggcgttaataatatgatgatatgatagtatgaagataattatgatgtgaaaaattataatcttatgaaagtttttgtctaactataaaccattacatattattgacaaggcaggcccaaagtgcatagctacctaaagcatgagttttttttttaaaacccataacacttaaatataaaaatattcaaaaaccacaaaatattggctcaaactcaagacttcatgttaaccttaaaacttaactttgtcactgtgctacatataattttcccgtatttgatgtcctataaatgatgatatattattagcacctaaagccctagctttacttgctttagatcaggggcgatcctgattactgatcaactcatctacttataatttctttgaccaatcaactcatttagaacaaaataataaaatcattaatgtgataagttaggttgatccatgaggtatgaatcccttattcaccatcaatgactgaaaatatagattaatattttagcggaaaaagtgtgatatcgtattgcggtggaaaacttgtgaaaaccatctatttttggcagaaaattgttcaattttactatctgagaaattgtgaaatagtgtctttagcaaaagaattacagaatctcattttttggttggaaaattatgatattgtgattatattgaagaaattgatgataaaggtgatgatgattatatggtgatcatgatgatattaataaagctaatgatgatgttaagtatgataatttatggtttaatatggtgaaccataaaccattacaacttactccaaacgatccactaactcactgacccatcaactcattatgatccaaatagtaaaattattagggttgatgaattagattagatcaaattgacacatatagtttgactcatatattaaaattttatttttaacaaaagaaagatgctgaggtttgagaaaaattcatttgaaaaaaatgtaagagcatcaaagaaaattagaagtggttcgtttgtgcatctagatgcatatacaagacattattcgttaaataacatttaattatatgagttggacttaataacttgatgcatttggaaaatgtaacttaagaacaaaaaatcttggatgagttttaaatttttaacttaaaggagagtttatatacaacacaatttccatctagaaatcacaacgataaccaagatagttttactttatatatattatcatattttaaaataatattctttcaccaaaacagtgaaacaacaaattatctatttcccatcaaaatcactaaactattaaactacatttgatggtataactatgtagtttgattgctcgagtaattcctcgatacaagcgcaaggtaaatatacatggttaatattctaaagagttttaggacttgttcttagctaaaacaaaaaaaaaagttgtttgttttgttttcagagttgtaaataaaaatgcaaataaattgacaattaaacttatgaattaaagacattgagctatagaatattttaataatcaatctagaagaatagatgtaacaggtaattcagaaattaagaactgttctcaaacatgaacacaaatttagattctctctctctctctctctctctctctctctctctctctctctctctctctctctctctctctctctctctctctctctctctctctctctctctattttgatagatgaaaaaatagtacaataccatattctcaccaaaaatagtagaatactgtttaccgttctacaaaatccgtgaaatcataattttgaaagacattttatgcatacatttttcccgccaaaaccttatattcaaggtcttatgtattttgcaccaaaactttaaaactaggtgtagacatccgggtacgcggatcgggttcggctaaaacccaatcaagtaaggatcttttggttagagagggccaattttaaagaccaatacccaaattttatattaaatactcgtgttttaggtaagattttgggttttcggtaaatttggatattctaatcaaatatccgggtatatttgggttcgtgtcgggttcttgtttggttgtttgggtcgaggagtttaggacccaataggataaatctaaatttttggctttggtttcaggtccgatttttgggtcgaaaaaaagaaatagtcatcatttcctatctttcgttctataaaaaaatttggaccctaattataatagatttgcttataaaaaaaagataaattttgggtggaccctgtgcatcagctcttccagcacaggtatacccagttcctgttttttgctaaatccctatttgaaaccacgatttcatgagttcataaattttgccagaaaatgcaattactcggatttgctagttttagaacataacatgattttacagttttggcagaaacatgatttcacgttctttgaaaaatgacgttccacgactttgatagaattatgatgcatttattgcctataaaggggaatatgacttattgcagttccaatattttgtttgatgtgtttttctaccctaataacggtccaattttttgtttcgtttaaaatttatttttctaccctaaaaatatacttgaactcttcaaattttgccttaatcagaatcatcgataacatatgttagtcaattgtaatggatgatgactcaactcacatgtgtatgacgattaggctcgaccgaattgggtaggacttaaatgttggacctaagactcatcaacatttttgaaaaaagggaaattggcaaaactaaccaacaaaaacgttatatttgcaaaactaacacctgaaactatatgtggtgtaatttctgtaataattccaaacataaattctgtttctttcagagaatttacaatacccaaatataaagcatggtatacataaagcgagcaacccgggaaagtttcgaagagtgatatagaccgacacggttagagtggcgaggcaagggtatccgatttttcgatttgggggtttcgcataatggcgacagggccggtgccggtgaagtcgagtaagcaacttccggttgtgcaatttgggggagggggactatataagcgtcgaatttgagtcgcggctagggaaaagcgagtacagttggttctatttgtggcggctcctatacgaacagcgaatttcaggaaacattggtggattagaagtgctccatcgacaaacgtggttgctcttatcaaattttagcaagtcggaggtatgagttgaaatattttgtctttgtcacaaatcattggttttagttctatgcatgcatctcagaaactcggatttgatgaactgtagtattgaaatttagtgattcccgaattgatttgtgtgtttaattctgtgattttttggttttagcagacatcaatcatttgtggttaaggtcggattgtagtgttaagttaagcgtgtatgtaatccagtttatcttaatgaaactaaaggaaagatgcttacatattgcatgtgtagtttaaccacctatatggtgagctattgaacatgtattgccaatttagattacatgatttgtataaatctgttttgggcatctggtaagcagcaaataagtgataatgttacctttgaatttcatggtatctgtcaaatgggggatgataagttgccaaagcgtttgtttcggcttggggctgaacctgaaggtcgaaagaggataaacaaatattttacactttggtggattgagattataaaggctgcacttgatgaagagcatttgcaacagctggatggttctcaatttcggagtatcttgcaaatggggacgcatcagttttctataatgttcttgcattacattctatctagacagttagtgacagataagaagtacgagatgtggtggttgtttgctgggaaaccaatttgcttttgcattgatgattttgcgctagtaaccggtctaaactgcagcaaagctggtttcaaaaagaaggatgcaagaactagagggaatatgaaagcggttcagaatcctacaaggttctacaagtttctatttggtaaagagagaaatccaacttcaaaatagattgtaggaaagctttctatggagaagaaatacaaagacccgctaactcggtttcgcctagctttgctgctaatagttgatggcattctttgcccgacatatgcgcgaacaatcatcaatccttaacatgtagagacggttaaagatgttgctgtgtttcttaaatatccttggggcagaaccttgtttctaaatgaactaaggaacttgcccaagatacaacagccatacaagagttcccgcatgcattagttcttgtgactgttaccgcatgtccaactatcatatacatgtcggactcggttatcagcatactagacccaacaatttcagttgagaagcttgttcagtatgtattaggaaggagcttgaaaatcaatatgcatgacgcccgcactatagaccaaaatggcatggtaattttttagttatatagactgctacttgattttggtattaaattgtgttttcatgccttaactatccaattcaactttatattgtaagaccggatcacatcactactaaatgaagaactacttgcaagagatatcgacttatctttctgtgatgaggaggatgatgaagaagtatcacacttgctgtccttattaatgaaggagcacccattcaagcataatagtttgagtggtggcgtggacgcttgtgatgttgtacaaccatctgatgatgagttccttgcagatgaaggtatgaatccgtctaagagtgatggtgaagaggagatggaggctgatgtcccaggtggtgctatggaagagagacaagagggtgcaaccggtgaatgtgaagacggcatggatgctgattttcttgttgatgatagacaaacacagaaagatgatggcaattttctggctggagaagatttgcagcatgatgtcccgattgctggggaaacgcaaaacagtagtagtgcattgatcaaagaggcacctgatgaatttgagtaaagttttctcaagattcaacaggcgaacacagttgaattgaaggcctactttgatactaaactagataagcataagaaagaattggtggaaatgattactgaatctattagggaagtggtaagtgggcaaaatagacagaaggctcaaaaaggggaatccaacaaatgtgtagcagagtcctgctctacaaaggtttggttactttgatttgctgtatatgttttggaaaactgaccatatatgttccattccattttcagtgacataatatgcttatgttacaattgtaattcatgaaacaggaacatagaagctttgaccagccagggcatacgcatgttggttcccagccggatgaacctgagattgggctagctggtggaagtgacagtgtagcgggtgtttgtggcataattggtggattaggtgtgttagatggcatcaagactgacactcttaaggaggttagcatacggtaaaaattgttcctcacttgttttaatgaataaatattacatataaatgtgatgtactattaggtccgaggtgacgatgctagtcagaaaagacggaaaaaaaaatctagttctgatatggacgcccaatctactcggccacttaaaagagttaaagagaaggaccaggtgtcaagcactaaggtattactatatctgtctgtatatttactccactagcacttgtgtttttggaatgaacacttactttactaattgaatttgacagattggaaacacagaagaattgcatgcaaacaacccggtaagacatgacaaagatgttaaattaagttaaatgatgtagatatgctgaactatttacatgggtatatgtatgcaggatgttaatgcagaagagcacttggatgatgattgtgatgttattgcccctaatgttttgttgggcctaccgcaagaaactgtggctgacagcagcaggttacctccaaaaggaaagaagaagacatctcccagaaaagtcacagtgttgcggtcaagcaaccggattagggacagtcccgtcatgtccaacagaagagagagtcggcctaccattccggtacagcagcggcaaacagctgttagagggtcgactaaagttcatgttgttaggcctggaaaatgggagaagatacctccaaatccaccaccatcttttattggtccgtttgacccgtttgctgttccaagtccagagagagtgaaatgttttcttaaaaaaatggaacggagagtgtaattacaggccctatatattcagaataactaatttgttatcgcaactaacttgctggtatatggtaccatgtagatcttatgctctggctgatggcgttgtaatggagaatactgaatttctaactatttacgaggcacagacactactagatgaatcagtaagttatacatgcaatcagtgttgtttcaaataaaactgtgtgctcactgcttctttagtaggcctaccaatattaatggtgtgtgctaataaaaaaactgacttccacaaggaccagatctgttagtgaggttcatccagatgcggctggataaaaagaagttgttgcgttttgattttctaccgtcacgtttcttgtcagagctacgacgccagtacaacaaattttgtgcagcttcagataagagtgctttttacttccccacacttacaagagtcccattcatggtgcagccgaaatggtttgatgaggttgatgtcatctactgccgaatgcaggtcgagaggcagcattgggttgggcttgtcatcaatttgaagaaatgggaagtcattgtattagactgcaagagggaagtattgaacgacgagcatgtggcgaagtacatagaacacataataatcatgctcctgtaccttattcgaaaccatggtgtaaacgggagaatgctaacacagaggctcgatcctatgacaatgagtagacccaacttacagttcaatgtttcgtcattaggtatgtttgtcttccatgattgagttttgctaagtgttttatatttgactggatgacatatatatttcacgtgtgtttttcaggccttgttggaattgcgtgtgtgatcttacttgagctacattcagttaacgccatggactattgtgctaaactagacgaagagaagatgcgaggggcagctaaacagtacgctatcaaaatgttcaatgccttgtctccagaaacacgtactgcttgagtcttacaagtgcaaaagctggcaaccaaacccgaaggttcttatgtaatctgtgactctttgtttttaaattcaacaattaatagcgatgtttgctatttacattgtactgttttgttggaggctagtgtaatttgtggattatatgctatttatacaaacactatcctgcttaaaaataggaatacaacgccttccccgaagaaaaaaaatatcgtctactttacgtgactacttagtagattatacagagttacttatatacaggcaacatgaaaataataagattttaattgaagcaccataatatttggagtacaacttacatttaggattcaaaacttgctgattattttcaaatagtacaataatggaatcttaatgaagcagattacggaccaaagaaggggaaatacacaaattgtgaggtttcttatatatacatttcaaaagcggtgttacaagacattgcatacttacatcggaattcaagaaaccaacacaaatatatacgaattgtaggaaaagtaaaatagtaaggtatacaccacatttggctataccaaactattttgaaaaatgtattgtagcctgcattaggaaaagtaaataaacccgcttccgcaaagtaggcgggaacaaccattattgtgcccaaaccagaaagttacttcataacaccttataacaccccatagcagtagttaacgttttctatagcattacggcaggaggctttgttgtggccaacaccacaacaacgtgaacacctcctttgggaactagacttcttgcgctgcaaattagaagtatagaagctgttagcttttaaaaaatagaatggactatgtactcttttaatgttctgaacttgccttgaattcaccacgagataatattcttattttccttggtctccaaggtggctacctaacaaatgatggatgctcctcccttgtcgttcctaaagtaattacgggtgcgtcctcccaaccaacatagtgaattggatagattttctcctcgtaacttagcttcactaactcactaaaatattcgtttggtgctaacgaatctgtaagaactccaagccgagcagtagcggctattgcgtaagcacaaggtatccctaaaccctgaaattccaagcaagaacaaatagactcgtccaatttgacaataaaacattcactagtccgaacttggacgtggaactcaaagttgcaaatcggcttaacagacattgacatggcggcttgatagatttcctatactctttcctgcactctcgaagataaagtggtagggcagtcttcaacttgatcccttctaatagcaaaccaatccatcaaagttgtttttatgtactcaagcatgcaaataagcgggtactcgcgtgcctctctaataacgttgtttcatgactcacatatgttactatccataatattgaaacgccgaccttttgaatgcactctggtctattctgaaaactctatacacgttacaacatacatggttatgtaatttacaatcatgtcaaccactttactataactatatggaagctgaacaatataataataaagagtaaaacaaacgtacccaaatcaactaaataggcaacacatcctgggtttaatttttgtatcttgagaaaaatccaattgaaatcagtgacatgaaacgcttgtgcagcttcagacattagtcagcagaggctttttggcttgtagagatgtctgacattccgccaaaggtgaacagtacaagcagagtggttggcttgggtatagacctgatgccaaagacaaaaaatcaaacagtacttgtcaattgtgaaccagattctatatgtagaataagtacatatctagcggtatactatataacacaatgcttcaaagcaatgttgtttctcaccttactcaagcccatgtatatgctaccatgtcggtcagatataaacattaaatcaggattgtctggagctataatgctgagccgctgaaaacccccgttcataagtgctatcattctcactgttaacgataccaaaagcaattgggaagatctaaaaattcccatcttggcaacatgctgatatgagacaaccaccgtatctactttcatagatgttccatcaacgacaatgaccttccacatgtatgcatagcctttaatagaagctgtgaaggctatgaattggtatttgaaacggtgtggaccatttggctgatcgtcatactctgtaaagcacatactccctgtgtttacttgctgaagtagcccagcgtaagcggggattagtgcgtagctgccggccatagatcctaatgacttctccattgccacctctctagcacgccaagctttccagtaggatatactaacatgatagtcgtcaagaaggaacttccaaatcacaacaacatttggcccgcttttaataccaagaaagcacgattgcataagttcccctattacttgagttgttgctaaatggtggtatctacgcctttgatcaattgtgaatgtgtgtctctaatttgcctgccgcacttgaaagctgtcagaagaatcaaccttagaggcatacacccgccatgaacaagtcctcgagatgcatttcaacaccataaactttggagtagaacgtgcagttctgaagtgaaacttgcggttgatggcgtgtatagctatcttaatcttgcaatcagacttggacttaaatactctgccaataaacagcttgtctccttcgtatttcacatcaaagaaagcagagaccacacctgaaacaaaatgaacatctttcagcaaatgtatgtattatgctacttaaatagaaccagtatgtctaaacacaatggtatacaagacataaactattttaacgaactagcaaattccaaattcttaaaacaaatcaacaaaacaattatatatgtatagccggattacaagttataccttcaccttttccatcattaaagaccggtggggcgtctcgaccgaatagattaggatcatcactaaaatcagagaggattgtgtttaaagcttcttgtgcccgcccccaaaacagattatactatatatagtttacacaagacttgatatacaagcaaagaatattagtgaacatattaatcggaaactatctttatccgtaacagttttgagggatgaagctgaaattggtccgattgatattaattcaattgtgtgagaggcttgtatgcaatgctacatcgtgacacacgtctcagcagagttatctatttgttatagttgacaaacttccattatccgacgactctgatttacacacaaattgaaaacattggactttgtttaagaagtttaagggggaaaaaggcatcgggccttgttcaaatatttgctcaaacagaaaaaagaattccaaaaagaattattaaagtttatcaagtacatcattttccgtccataaaattgtattgacgatgttgaatgtccatcaaattgatctttttatcttctattatcgaagactctgatttacacaaaaatggaaaaagggtattatatgtttctaaaatgtttaagacgtttaaggaaaaacaagcattggaccttgtttaaaaaaaagtacttgacagtgttcaaatagaaaaagatcccaaaatgaattattaaaattgaagtacgtcatttctgtccataaaactgtactgacgatgttgagtgcccatcaaattagtcattttcccatcaaattgattttttttatctcattgaatcaaaaaagagttatgagaattttagacaacaaaactgtcaaatattaaaaaagttataatgtttaaaaaagattcaaaataatgaagctaatatgtccttgactttttttttaaatgttttaaaaatattttgtttaaaattagataatgttttaatttaaaatctaaaattactattttttaattggttttgatgatttgtattttacagattgttttaggattgtttgatcatatttagatagataataaataatattgtaggttagaaatcaacaaaaatcaaatatattttttaatcactatgcaaaaactttaaacctcaaggaattatgaggctgattgagtattaaacaaaaacaacatagtcgtattgaaagcatgtggtggggttacttggagacaaaaagtataacttataaccgtattgaaagggtacagtttacacaccaagtgattaaatcgctaattctaaatgtttaccctttctatacggctattagattttaatgcacatatgtgagaaggtagaagatgaccaaacccttgtgaggttctaaaatctgctttggtcttcttcagtcagctttccttagtgaaagaataaaatgcatatatttgtttttaaaagatactatacgtgtatttaaatgtggatggtgatacatcaacaatattaagacaaatttataggttgcgcatgtcttagtcaaagttttctaaaatatataaaaatagaaaacaaaactatttaacttatttaacactcactagacttttgagacttattttgcattttatgtatggaattctttgttttttttttgcgcaactatattgaattctattttctattgaaacatataaactctttattatatgtttatttgtagtaatttcttagtccaatattcaatagtataaatgtttctaatcagatatagacatataatagtcgattagtagagaaagtacactattacaaattactgatataaaccttatgagaagtttcggcatgctacagatagagaactattcgacgtggtcttaagtgtgttgcaaaaatagattaagaaggtatagaggatgattttgtttggaacgcgtcaaacaaacgttttttctttatttttattaataataaatattttagaatgattttattctctaggtaattatttgatctattatacccgaatgatcaaccccgactaagaacaaatctaagcttaatcgttcctctgtttcttatcacccgcctgattacaaacacccactttctaagcttttgctaggtttcgaaagctttacacgtatggcaatattctagagtgcttaggcggctcaatgcctactcctagaagatttatgctattctcgctaaccttaatccctaggatctccgagaatcaatgagcggaatctttcttgaatcgtcaagcctatttcttttccttgttcgagatcctccttaatatttaagcctatctctttccttgttcgagatcctccttgatattcaagcctatctttttccttatttgttgagaagaatattcaccaaatcttctcaaccgactttcgtctttaattaccatgccaagtcagcaaagcttcttgacacgtcagatcaaccactccagctccgccatgtcagctcacgcgtccatgtcagcaactcagacgtttgatgtagatttgatgcagcttcctgatatccaacagctctctgatgtccatcagctcgttgttgtcagaatctgcatcttcaatctccccctttttgacttagtttgatactcaagcatccttctgattcaacttgaaaagatactaaacaaaccaaacaaagataaacagaacaagcaatatctagctatagataaaagcttgttcatatgagaactatcttaagaacgcaaaacatcaataacagcgaaaatcaaattcttaaccgtttacatcactcagaagaattctaccaacgaactctaacaacaggcagtgaaactatgtctaaactcaaaacgaatcaaattcaaacaagtctcccacataaacagtgaacactgctcaactagtaattagtcaacaatacttatcaagtaatcagtcaactatgaacattactaagtagtcagcagtctgtcaaactcccccacaatcaagcattctataaaccagagtcatctccccctgcttgagtgcataactaagttaaaaacaactagttacagaagatctacattaggacaagtagttagaaatacttacctgaaatcagtgtatcgtaacacactttgatgaccatccacttctcagactactgcagccaaaccgggtttgcttccaccagctgtttgaatcaaacaatctccttgacgagacctgaaagtcaaacagaaggaaacccaaacacagcaacaagacaaaatctagaaacgtttctagcatacctatcaaaagataagattcgtccaagcagctgtgtttaacttattacagacccaagttttcagaggatacatatcatcagttcaaaaagaacaaaaataaaagcatggtgtgaaataaaaacaagcttgtcaaaaacaagattttaaacgttaaaaacatcaagctcccccttaaattagtttctcccatcatcagattcagacacatctcctcctgcttaagtgcatgacttagtcaaaaatcacacaaacatcattagctgagatataatatttcaaaggaaaacagaaaaacacttacttgcatctaaagcagtctgcagaacttcaatggccagtttcattgctctacgatgttctgaaccatcagtggagtcaccagcttgcactccttgggttgatggcttctttgcagtcttcttcttagtctggactaagggctctggcttctcaacaaacttcacaggatgctgcatctgaagaagttgatacacaggactcggaaacggaatgtagaactttgcctcaggtttcaaagcaagctgcagaatagaactttgcctcaactttcaaagcaagatgcacaatatgctcatacaccatctgcccaaagtcaaaagccaacttgtgtgcaatccgatacataagcaaaaccctgtgtatacttgcatatccctcgctggtcgttggagaccaatttctgcacgagaacttgaaaagcttcctacagttctccgagaaggtgctcatcggaagactctgaagaaccttcacttgtccgttagtcagatagctggtgacctcatcatcaatcagactagcaatttgcacctgtagagctctggcatcaactaattgcagaccaaacgaagcgttgatcttggcaggagagaatttgtactccattcctcgcacacataccttgacagaatcaccttcgacctcttcttagcatcatgagagataaatcgcaagcggtcaaagccatctttatcaacaacacttgaactagcagcttcgttcctatcgttagtcttctgtctttttatcctctccacaacagcaaactgttttcttttcagcagacgcgaggacacagacagatctgttgagtcaacagcttgtgctgattcagatgcatcagagatctgcactacttgaggattcttgttgttgagttatggaacttgatcacaagtcttgtttctggtctcagcttgaatgggtgtctcagatctatgctcatgaacaacagaagattcacacacgtcaggcagttccacaatcaccggtgggccgcctgttcatcttggttctcattgtttggaagctcagatctgagagatgttggttcgggctcagcatacaacaccatagctctgttttgattttcttcctcttcagctttcagagactgcgatggatgctcttcagaggctgcttctgacaggttcggcgacggtgtcacagatctttgttgcacgagccgttgaagtccacagaaaatcgcattcatcttcaagaaagatttcaacttgattctctttgagcacaagtcttcgaataaacgactccctaggcaggtttaatttgacatgagaaaccctaactctttttccctccaacgtagacattaagtaatgggcttaatttgttcatgggccttcaaaacaaatgggcttaggctgaatacctaaaataattagagcctgaaacactaaacaaaaacattagtgcatacttgcaaataatcccattgattcatatcatcccattgatcaatatcacatgttagcatagttcagattaaaaatcatttagcgaacaaccattcactcatgaacagaatttagtgacccagaaagttattgaaacatgtgagtacagtaagttggattcaaaacatttttatacctttgagatctgttccgtgttccgtgccaaccacttgttcagaactcagcaagaagctaccataaccactcagatctttgatagatcaactctggatacagtggctagtctttcacactatcatgccttcaattccagtagatcggctcaacgtataacaggcagctggaattttcctttggagattgctcaaagaatcaggagtgtgatgttttcatttccacacttccttagatttagatacaacagggttctccttttttttcttttctttttttaaactttggatcccggttgatctatcagtttcatattagcagcatcacttgacttctcaactgctgatatcagtgcatgatggtcatttgacaccaaattaggctttagatacccttagtttggtttgcacaatacattgatcttctcagcgctttgacctttgttagacgacaacgttttacagctgactatagaatcagcatgacagtatgctattttccacacacctttattcacagagtgttgatcttctattcatcctcggatttccatagcctgttcttgcattttttgctcttgtcttagatcaacacatctcacgaaacaaattagatctcaggcacaccaattaactttctcagatcactgaggctattaaagtccaagattttggtacacaaatcagatagttgatattcagtactcacatgatcaactactatcagtttcgcctcaacaagtttacagatgaaatggtgtagaatatcaatatgcttagtgcgtgaatgttgaacaagattatttcctatgtttattgcactttgattatcacaataaattagtaaagaatcagagatcataccatagtccgctaccatttgtttcatccacatgatttgagtgtagcaactccttagagcaaggtactctatttcagtaatggatagagacacaatattctgctccttactctaccacgagaccatgttgctacccatgaaaacgtatccaccacttgtacttcagcgaaacttccacggatccagcccagtcagcatcttgcactgcatcagactcttataatgatattcaggcactgcgactcctgatatgtacagagactcatccactttgactccagatatgtacaaagacatgtacaaacaccatcagattcagttcctgattcatccgccaccagcaggcttggtaactttctccccccgaatccttcccatagcttcatgtgggatgtgatttgaatacttactagactgctgcaacttgctactagtgaccaagtcctgactatgtaggtacttcggattcagaatacctctttgaacgaactcctttgaatgtggattggatgatttccacatgtaatggttaccacctgtgatgtgtccttggtcacgacagtaccaacagttcctcgttcttctgctcagttgtttgacactcgactgactaactcttgcttttgacctcgtccttgccttcacataaccagacttagcaaagttgttaacaagaacagctctattcataaccttatttgaggtacatgaatatccacagttacgataaagatcatctttctttatgtagacttgattcccttgcttatcgttcttgtggtgctgcttgtggtgcctgacttgcgtaacacgattcagctgtaacaatcagctctgtagtgtttctgacttccgcaataccaacatcctgttcttctgctcctcagatgattgtgatcaacctaataatctgactgcctccagttctgagtaggcatactcctggtcaacgcctttcgagccttcgagggtgcatccttgcggtgggcttttactggtttgatatcatcagatttctcatctgaagttgtccctttgacaaaacgcgttcctccttttgaacttgatccatcatatccaagacgccaagtaacgtttgaagttcttccaacagtcaggagcttatccaagtctttagtccccctactcagcatcttgatgtttctcggttggtcttctagctgtttctccaatccttggatttgattctctcttcaccatgctcctttcaagtgcagaaactttttccatcaagatttccttttcagaaatgagctccttattttccttctttttcagaatcactctgaatcagtatcagactcttgatcgttcccatctgagcatcttcctcaaccgtgtggtcatcatcttcaatggcaccaaaataggttgcgtagctgttgagaatttcttccttatcagtatcatacgcctgcatcatcccaacaacctgatcaaactttaattgatctgagttcaaagatacatcaatcgctgacttgtgtgattgaaacttgtctggtagactcctgagaaattttttcaccatcttcttgtccttgtacgtttttcctaggacaacagcctcttgtgtgatggagctcaatttgccgttgaagtcatccacggattcttcagcttccatggtcagattctcaaactctgacgcaagcatgtccagacgagtacgcttcacattgttggtgcattcaaatgagacttgcagaatttcccatacttcctttgctgataagcatccttgaacctgagtgaacttattccttaacaaagatccaaaaatcacagacagtgcctgagagttgtgattggctgctgtcttctcatccgcaatccattcagtccttgatttcgaaacaatgtctctctttgcatcctttgtggtaggaggcatccaaccatcttctactgcaaaccatgcatccatgtcgatactttgaatcgatcgcttgatcaacaccttccaatacccgtaatgctcagcatccagcttcagtggcttaggtatcgcaatgaaccgttgtgctttctccttcccttgtcgcaagatctcacctgttgaacagattcacaacttcttttaccaagtgtccgctctgataccaattaagagggtatagaggatacacaacacgctgattttgtttggaacgcgccaaacaaacgttttttctttattcttattaataataaatcttttagaaggattttattatctcggcaattatttgatctattctaccctaatgattaaccccgactaagaacaaatctaagcctaatcgctcctatgtttcttatcacacgcatgtgaagaggagagattacagacacccactttctaagcttttgctaagcttcgaaagctttacacgtatggcaatattctagtgtggttaggcggctcaatgcctactcatagaatatttatgctattctcgctaaccctaatccctaggatctccgagaatcaatgagcgggatctttcttgaatcgtcaagcctatttcttttccttgttcgagatcctccttgatattcaagcctatctctttccttgttcgagatcctccttgatattcaagtttatctctttccttatttgttgaaaaaaatattcatcaaatcttctcaactgactttcgtctttaattaccatgccaagtcagcaaagcttcttggcacgtcacatcaaccactctagctccgtcatgtcagctcatgcatctatgtcagcaacttagacgtttaatgtaaattttgttggaaactgaagcctcttgttacaaagaacaaaacaagtgtttacttgttgttctgtttcttatgaaatacacagagcaaaagagaaactgacttttattgaatggagaacttgttcgtttcatcacgatacaaaaggtttaaatagaaaacaaatagacacaacaagtgaagagttttgtctctttctctctaagataaacggcacaacctaatctaaaagtcacgactctaacaaacaccttttaatacaacataattataacctatagaccaaactcaattataaactaacattcccccttaattgagtttcggtcttactccaagcttcctccttagttcttcgaaccttgccttgtttactccttcttcacttgctagtaaagcacttgtgttcgcctttatccatctcaatggaaaactcttctgcatcatcttcatatccagtatccttcttccttgaggatcgttgatgagacatctgttgtcttcaaataagactctgtatcccttggataccatttgagaaacagtcaacagatttcttgctaaacccggcactagaaacacctctttgatgatcttctctcattggcttgtcatcacttggatatttccttttcctgccgtcattacatgttgaccattccccactttgatcggtacctttacactttgatcaagagtgatgaagtatttaacttccttggtcatatggttagtgcatccgctgtcaactagccatgtctcatcattcacgtttgatgatgtttcttcttcgactgcactgaacagcatgtgatcctcatcatcatttgtttcttctagacttagatccactcgctcggtccttctaagtctgcagttctttgctagatgtcccggtttgttacacacgaaacatcttctctcattgttccccacttgttgcgaaagaacacctttgttcttcttcatccagcaatcactctcattgtgatttttacgttcgcaaacgtcacaccatttcccagcctgcgtttgacgcttgtcttcacgtttgttttctccatagaacgctccttccgttgatcattcgtctcgcatctctacccgcttctcgtgtgctttcaatgtgcctatcaactatgttacggacaacgaagtcagatccttcgtttgcttcatcatagccactatgatgtcaaatcttttcggaagagaaattaggattttttgcactatttgatagtctgatttctcttctccatgaactctcagttgatttcccatctcaatcaacttggtcatgaaagtgttgatattgtcactttctttcatcttcaaattctcatactcccttctaagagattgaagctttatcatcctgacttgtggtgatccttgaaattccaataccaaggctttccaagtgcgcttgatgcaggggcgattctcggaaatatggaatctgagacggcagtttgaagaatttgcaaagcggttagatcctttaaggatgctgcttcacatcgtgtcttttgttgcactgcttcagggctatgatctccttctgcgggtggttttggaactccttcgtcaacaatttcccacagtttctttgtctggaaaattgttttcatcttgatgcgccaaaaaccataattctctttgttgaagattggagtcacaatgtgtgacaccatctccataactctctcgtgtttattaaactctttacttgaaatgtttggcccttgaatcagtagggctctgataccatgttggaaattgaagcctcttgttacaaagaaaaaacaagtgtttacttgttgttctgtttcttatgagatacacaaagcaaaagagaaactgacttttattgaatggagaacttgttcgtttcatcacgatacaaaaagtttaaatagaaaacaaatagacacaataagtaaagagttgtgtctctttctctctaagataaacgacacaacctaatctaaaagtcacgactctaacaaacaccttttaatacaacataattataacttatagaccaaactcaattataaactaacagatttgatgcagcttcctaatttccaacagctccatgatgtttatcagctcgttgttgtcagaatctgcatcttcataaatttataataaatataaatatataatgtataactgtatgtagaaccgtatattgtggatccgtgaattggtggaagagttgctattgcggaatcgtccaagaagctattcataaaatcaatcacgaaagaaaaagaatttgttttgctattatctctatattgtgggtagccatttttggaatctttgaaaaatcaaccaatacgcattttctctcagtttggaagttaacaaagacgcgttttttcaaggttttgtggggactggggaccaaaagttcttaatatgggttaacgtctcacaggtaataccaaacatttcatttatttgtgtttttctatcactatcttttccacattttagtattttactattacatataatttttgactaagaagttgattgtgaatgagtctgtacatcttcctagaaatgattataagtatattatttaatttgttactccctctattgtcatttatttgtagtttaagtttcaaggttttggcacaaatgaaattatttcgttttttattattatcttttaatatagttaattatctatttaaaaacaattcaacaaattgaaaaaaaagttttgtagaatttctaagagtcaaaaataataaaatttccattaaaaattgaaaacaacaaataaaatgaaactatttgtttttgcttaaacaacacttcttaaaaaacagaggaaccattgtaaaatagatttttcccaacacaaatcgaaaacgtaacttatataatctctatatttttagtaattcagcgacttatcatttcattgttaactatttttcactgacatgtttctcgttatataaaagtctctgtttatgtcaatggtcgtatgtgaatggttcatgtattatgcaaaactgtttatgataatattgccggggaaaaaaaactgccatgtttcatttttttactagttattacatttgattattatcaaccaacttaccattgaaagataacttgtgattattatttacagtaacgaagaaaattaggccatattttgttttctttttggaacctttcaaatgtcaaagctggtaggctatataaatataaacaaagctcaaaaatttattactatacttaacagtaacgaagtagactacttcaagtagtacatcaaaaaaaaaaaaaccaaagaagttgttatctttaacaaacaaaaatgggaaaatgctctgctttgatgatattcctctcttcttctcttctacttgtccttcaaacactccatgttgttaacgcggtcaaatgtttcggaaactccttcaacggtaacagcagcaccttcgctcagaatcgccagaaactgttccctactcttgctgacaaagtcatcatcaacgacggattctacaacgcttcactcggccaagatcccgacaaagtttacgctcttgtcagctgcgcaagaggctacgaccaagacgcttgttacaattgtgtccaatcattgactcagaacacactaacagattgtcgaagccgtagggattcgttcatatggggaggcaatgacgatgtaacttgtcttgtacgttcctcaaaccagtctacttttgggagcgtccagcttaaacctcctgttgtatggccaagtccagatactatagagtcatctaaaaacataacccttttcaaacaacagtgggaagaaatggttaatcggaccctagaggctgccacgaaagctgaaggttcctcggtgcttaagtactataaggccgaaaaagcgggtttcaccgagtttccagatgtttacatgctgatgcaatgcacacccgacttaagttcacgagattgcaagcaatgtttgggagattgcgtgatgtactttagaaaagactatatgggaagaaaaggaggcatggctagtcttccaagctgttatttcaggtgggatctatattctttccataatgcttttgataatgtaacaagagttcctgcgcctcctcctcgacctcatgctcaggaaaaggagagctgcataacagtaaaaaaaggtaacacaaattattttagctttcatttagagctcaaaagagccaattttgaggaatattgtttacataagtgacatgaagcggtttggtatgaacttttcgtgccaaattgttattatgattaagaggttaattcttagacaaagggttggtaatttgcagggaaaagcattgggtatggcggaattatcgcaatagttgtggtgtttactttcattaatcttttggtgtttattggctttatcaaagtctatgcacggaggggaaaattaaataatggtaagtgtaacttgcttcaatcaagcttatgatgtagagagtaaggcttatggattttttgtttttttagttggtagtgcagaatactctgattctgatggtcaattcatgttacggtttgatcttggtatgatcgtaatggcaactgatgacttctcctctgaaaatacgcttggccaaggtggatttggtacggtttataaggtaataataaactttttccttaatgatgagttcttgatcaacattggtcttttatgagtaaatagatatcttgagaatgggtttcaggggacattcccaaacgggcaagaggtagcggtcaagagactaacaaaaggatcaggacaaggagatatggagtttaagaatgaggtttcactcttgacaagactccaacataagaatcttgttaagcttcttgggttctgtaatgagggagatgaagagattcttgtctacgagtttgtccccaactcaagtcttgatcactttatctttggtgagccttcgaaagacagctgccaagttggatagatttagaacttttagcaaactaaatgtttctttgaactctgcagatgaagataagcgttctcttcttacatgggaggtgaggttcagaattatagaaggcattgctcgaggtcttctctatctccatgaagattctcagctgaagattattcacagagacttgaaggcaagcaacatacttttagacgctgagatgaaccctaaagttgcggatttcgggactgcgaggttgttcgactccgacgagactcgagctgaaacaaaaagaatagctggaacccggtaagaaatatatcaatcaaatttgatgacacatttcaaatgctctgttttgaaaacagagtccatgaattaatgctattggtttgcatatatgcagtggatatatggctcctgagtacttgaatcatggacaaatctcagctaaatctgacgtttatagcttcggtgttatgcttctagagatgattagtggtgaaagaaacaatagcttcgaaggagaaggacttgcagcttttgtaagcttcttcacaattttttttttttttgaatagctggaggttttgggccgaagcccgtaatccccccaggaccgaaaccacagcatgtaatattagtttcgttccaagcgttactcgaaccggcgaccttaagcttcttcacatatcagtttttgtttttctatcttcaaaactttatcccgaaagtaagaacttatgtttttggtgtaggcatggaaaagatgggttgaaggaaagcctgagattataattgatccgttcttaatagagaatccaagaaatgagatcatcaagttgatccaaattggtttgttgtgtgttcaagagaattcaacaaagagaccaaccatgagctctgtaataatttggcttggcagtgagactatcatcattcctttacctaaagctcctgctttcacttggattcgatcccaatctgaaagtggtgcaatgtcattgagcgacgatgtcttcacggagttgagttgtcgttgagatatacatcagttaatcaaaatatttgaatattttttaatatcaaactccattaatctgcaaatttgttagtaaatcgcataatcttggattcgaactttagacttctttggtgtaaaggctttattaactcttgattaacctttgggccaagagggttttcgcgtccagttttgttttaaaactattttcaccaatattaattaatattatagaggtaagaaataaataaacttaaaatgttgcacatataaatatgatttaataataactgaaatatcttataaatctcaattaggagaagataataaatcttttcttaacaatcagataaaatatcagttcttaatttcagttactttattctgatatatcttactctaaatagaattataaagaagtttttttctttctttttgttaaaacaaatattataatataacaattgtttttaagtattttcacattaattcccaaaacaaaatatatcacgtacctaatatagttctccctaatatatttcttctaaatgaccaataaatttcaaagttgattttaattttacatgaccaatagagtgaggataaaaaatcttttctgaccaatcaaattcctgattttagccactctacttgattcttatcttagtatgaacatatatataaggaagttttttttttgttgttgaaaatataatataaggaattttccttgatattttcagaattcccaaataagagtatatctatgtacctaatatagttctttctaatatatttttctaaatatatacctaaacaaaatctagtgcagccgaatattgtcaaagactcaaagttgctttcaattttgtaatagaaatattttatataaataatatttcccccaaatagcatggatgcaaaatcacataatagcattataaatagaataccataaaatattgttcagtttttatttttcttatcccattatatatatgagataagcattacataaaatagagagcaagcataaaaaaaaagatagaaaccaaactcctcttagtacttgcgaccaagagtgagttcaagggacaattcttcttcaccagttgcaccaccaacaacaacaacatcattgcctctgttttcatttagtccaacctgccataaaatatacattaatctagtttcataggcatcaaatcaacatgttgataatcatgcatgatatttagtaatataaaaattacaaaaggaaaaaaaaattacctttgaagattgatctagagacttgttacttgatcccaaaactggggttatcttctcagtattatccagttgtagcctagaagaaattgaaaaagaagattgttttactcacgaaaccaaaaaacgattaattatatgaaaaactaagttgatacatgaacataagaacctttgttgattttggataaattgggtagcacgttcatagatttgaagatattgctgagattgcctctgtgtcatctcccgcatcatttttatttctgtcaaaggattggaggtgcataattatgaataaacggatataaacttcactatgcattatgttgaaaatctaaatattccttatgcaaagttacacgacaaacatatttattaaaatttaatttaaaatgtaagatagttattttacctttactagattcttctttctttttgttcctatacatctattgaaagtaaaaaaataaaaaataattcagtacttgccatcttagatagtatatgttttgtagataagttttatacactatataattataaagacctggagatgacttttgacatgtgatattgtgaggtctctcacacccataagactcaaaattctcttaggagttgcacctgcaaatttaaggagaacaataatatcgactatagtgaattaatctaaaaaaggatataaagagaacattaatcatggaaaggtcttaaaaggaaaaaaaagattgttgatttcaatgacaatttttttttctttgaatttatttcagaagaatcgtcttgttatagttttgcgatatggaaagaaaaccgcttactctcttcgccaccgagtttttcaataacttgaataaaacggatatcaagatcgtcggtccagtgcattcgcggattgtctgacctaatgtaagatctaaccatcggatcttgcattttttttatctctcgtaaaatttttagtttgataatattgagagtgtgcaccaattatttatagaaaaattatatggaaaagaatattaatatttatttcccaaaaataacctaagaaacaaatatttagagctagtaaatgttattgttgtcacgtgtaatttatcatttaaatatttctgtaaaaaggatatataaaatcgcattttaagaaatatttattttcttgacagctccatgtgttcttttctctaataataatatttataataaattttaaaataaaaagttaatactactagatttgtttcaattttattctaagaataattctatctatgcttgatatttatataaataaacaaagaacaatccaaaactaatttatggcataaagccttaatgcttattattatcattttgaaccaaatgatataaataacttaaaaacatcccaaacaaatatgaattatatatgtcattatattaatataaattagttgtagacgatagaaataatatattcttattagattaaaaaattctgaaatttagtttttataaatgattatgctatataagtagttttcatttattttttttctgatttctcaagtaattactcgatacaagttagtataaacgcagtcgatccagaaggaccaaagatactctaaggatttccaagactcatttttagctagcgcgaaaaggttgtttgtttggattttcagattgtaaataaaaattgcaaataatttaaagatcaacttatgaattaaagacattgtgctatagggtatttcagatatcaatgaataatgaaaacattagacaaggaattcaaccatgaagcatcgggcttgaacatgaacacaaatttagactaagtctctcttaagacattaatcattatatttaactatgcaactactaaactcttgtttttaattttctagtcaaatccgtattagaattaggttcattcggttcacaatgcattctaacataaactctcattggttagaaatacattgctcaatttacatttgttcagacagtctatcaaacatttttgatgcatagaaaaatctagaatctaaaacagagtgttcgatctttttctagcattaagaacaagtgaatcaaagaacttaaggattaaaaactcaagaaaacaatcaaaccatcaattcattgaatctcctacttagaaccctaaaacccaactaaaggactatttactcatagcaaaaggaataacacaaagagatgaagaagacataatagattactaaacaataaaagaaaagggattagaaatattttccaaagtatcaaagaggatgaatctctagaatcccaataggggaataaaaaattaggtctcaaaaaccctgctctataaaatgaaaaataaaactgcttaaggaagaccgaaactgggcatcaggtagttgcctgatgagatttgcgtgatgtcattccccaaaagatttttaggcaagaaaacgaaactgggcacaagtagttgcatgataaaatttgcatgatgtcattttccaacagagttgtcttgaatcaccaatttttcatttcttctccgaactcttggttttgatacaaaaacgcctccaactccatcattgcttcctaaaacctgtaaagactcaatcaaggactggaagactctaaaaacatactttgactctataaaataatgatttaagaaagaaaacaaagactcaaaaccgataaaaataaaacatatcattttcatcgaaattataagtagttttcatatacagggaaatctttaaaaattaatacttcaatttatagtgattattgatttaaaaaataatacttcaattaatttatagagacggaggttattttaattacttcataaattaataatcactatacaataatacttcataatttataggattttcaaaaatattattatcttatcttctcattgaattatgttaaacattgcaatcttttgctaacatttatgcatcccatgaagggtggcatacattttagcaaaagattgcaatgtgaaggtagttggcatacattttagcaagagattgtaatgtgaaggtagtttgagctcaagtatatatatgtcatgtcattcatgtcttcactagattggactttaatggactcgtttcttaacagaaaaagtagacatacgatgtgtctgcgttacaaacatgtccatgaagacagttttctgatgatgtagacccacaagagcaacattccttataagcccgtgatcgggcatgaaaactgaccccaacttcaaacctaatatctctaacaggtttgattattggttgctcaagaggctgctcatcttcaaccataaaaaggtatcaacatactcaccataaacctcttctagagtagggtaatacttcttatcattaggaagaacaatttggttctcaatctcaacataacatcattgattgtaataatccaaccatccatgtttgccatgtttattatcttcttcatcctctctctctctctctctctctctctctctctctctctctctctctctctctctctctctctctctctctctctctctctctctctctctctctctctctctctctctctctcaagtccgatatagttaccaaacaagctatagtcctctttatgtaaaccatgccgttgaatagctttatctgaaacatcactacaagaatattgggttttaatagcactataatatagcgtttatgtcagtaatgctattgttatgtaaccactttattttaaatagcgtttatgtataatgaaacgctatgatataataaactataagtcacgtgtttattaatcaggttttcaatagcagattttaataaaaacgctatgttaaagttaggcggtaacctaaaaaattagatcccgtacttagaaaaatttcattctctttggcatcgaaaaatccccaaaatttgcagacctaattttcttccctctctatcaatttctctcgatttgtttccctctctatcaattttgctcgatttctctcgatttcttccctctcagtattctcttccaaccaaatctagctcgctcagtcacattaatctcatctccggtttgatttaggaagacgagaagacaatatctagctctctcagtctcatctccggttcaatctcagtcttgttcttcacgttcttcatctccggctcgatttaggtatttcactcttatcctctgttgttatcagatctcctactctattcttgtacatgtttaactggaattctctttgataattgtatacaccgtcggagtgtttgtaccatggataaagcttgggtctggttaccaaggtaagacgttgctctcgttctctttactcttctttaatctcgttatcggtctgaaaaactttaagttttctaaaagaattttgattttgattgcttacaggaattgccttgagtatgaggaaggagcgactaagtttgtatttgattcagcaagctgtttgggtaatgtatcagatatgctttgcccttgtgttgattaccgcaatatggttcatcagtcaaatgagacagtgttagagcatctagtgattagagggatggatattaagtataagagaagtaagtgttggagtaaacatggggatagaagtaacaatacagcagaacagacgtctgagtatgaggcttatgatttgtttaggacagcttttatggcaagtgaggagaagctaccatcgcagcaacataatgttgaagagtcagaaacaatggacagtaaagaagaagttgagttcagaaagaagttagaggatgtagaaactccattgtattcgacttgtctgaactacacaaaggttagcgcaatcatgggactttataggataaaggtcaagaatggtatgtcagagaatttttttgatcagcttctgacacttgttcatgatatgttaccaggaggaaatgtgctgcctaagtctacaaatgagatgaagagatttctgaagatttttggttttggttatggttccattcatgtctgcatgagtcatgagtgcatctgtctggagacctactccaaccattttcacacttggtgaagctgtaggaagtaaaattgcatggcccgctgacaagataatattggatgacgatattgacttgacacaagataatgtgggatcagaggtaaataagaactccatctatgttcctcttgcagtcatattgattagattactaatatagactgtggattatttgcatgactcattagcaagcggatgctaccattggaagagttcacatctatcaatattggaatggagatgatgaattgattgctgaaggtttgttgttgtcaactgatggtgaagaattggtagacggtagacctctgggacatggtgctgcagccattaagatcgtgttggtggttaaacctgaagcttatttatggagaccaaatccgccaatctcattgatgagggatgcactaaatgagaccatcgcatggcctattgataggttacacctacttgatctacctgcaacagatgaatcaaccaaaaaaacacatcgagtaagtttttaattaagtagcttcatgtttagattagaaaatgggaatattagagtagcttcaggtttagattagaaaatgggaatattagagtagcttccttgatgtgttgatgttgctgtgatgttgatgttgctgtgatgttaatctgatgaattgttttaaattttttgttgttagagtactagtactcccagcactggtaatagcagcaaaggttcgaaacagaagtgctttctattagatattgataactctgggaagaaagttgcagtaggtcgtgtgtcttcaattgatccagcagagaaggtccatcacgtccctttaggttccaacgctagcaaggtctgggtagaggtttccaaggttgatggtgcacgagtgtggaggccaaattccgaagttacattcatagctgatgcagtaggaaccacagttggttggcctaatgacaagattgtatttgtgtgacaatatttgtggaacaagattggtcttaagtacaatgaacttcaaatcttggtgtgtattgtgtaaactaatgttgtatgtgacaaattcataagtattttcattcaatataatcgtctttctatatatcgatttctctaatttgaatcaaattttaaatttcgtttagaatcaattatagcaagaaacaaaattaaaccattacattttttgaaaagctatattaaaaataaccataacaatataaaaatgttgttaatagtctaattataacaatatgattacgctattaaataatatttaaaccgacgaaatcgctattgtatattgtaatataatagcagacattataaacgctatctaaagtgtctgacctacgatgacgagcacagaaatagcgcttaacgaaacgctattaaatagttagatagcgttattcggatgctaccaaaagccaatattcttgtagtgcatgttggcccctaaagctatttgacaagtttaaagaaggagataattgtttagggtttcttatcttgtggttttactatttgtcttttatatttataaataaacttggagggcttcaaccatctaagctgctccttaactccattttgtggtcagtaaactatctattatatgtttttcttttgacgaatttctttgcaaaaccaaatcttggattaaaacatgagcaattttgagaaaatatgggcataaactttctcaaatattaaaagaggagacaatgaatcgcattggaagtaagaacttggccccttgaagaaacgacatacattaacaacacaacagccagaagatcaaaacctggaacaaaatcatgaacaaaaagtccaagatggaatttttgcgtagtaatcatcaaagtgtctaagagaacaccatgcaaagctagaatcgaccgaaaacttaagctaattttgactagatcaaaatcctaggctagaaccatccagaaaccctaggttatcatacaaagatgataatatagattggtttgttgtgtgttcaagtgtatcatacaaagatgccaaccatgagctttgtaatagtttggcttggcaatgagacaaccaccaatctttttctcctgctttcattaggagtctgagaatggtacctaacatacaaattggctatgagttcagttagatgataagtttttttttttgtgcactcagttagctaattcaaatgttatttttaaggtataattgttgtatgtgtcatctaaaataaacttcaaatgttgcacaaagtaatatgatttaaattttaaaataaccaaaatttcttataaaccaagataaagaggataagaaatcttttctgcccaatcagattcttgattttgatttaggttacttgattcctatcttactctgacataaatataaggaagttttttttcttttttgttaaaaagtgtaaagtaagaaattttctaagcattttcacattaattcccaaaaagaaatatatctgtgtaccttatatagttcttttgttgatacctaatatagttcttcctaatttgttttttatatttcttctaaatatatacctaagcaaccaaatatttttaaatttgatttcaattttggcataccaaacaaagtgtgttctactacatataaaaacctctttaggagatgtatttttcctgatctcatttatttgattcttatatatcttactctaaacagaaatataaacaagtatgttttctttttgttaaaaaaatactataaatgtataaggagattttctgagtattttcacattaattaccaaagagaaatatatcacataactaatatagttcttcctaatatatttcttcttaatatatacctaaataaccgaatattttcaaagttgacttcaattcttttcatccaaacaaagcatgttctactaaatctaaataccattttaggtgacttattttgtgcttcaaaagaagcttgttttttattgtttgttccattttgctaccagtatatacttttaatagaattgccaatacccacaaaactttacttacaccattcaaaagctatgttgtttttgagactttctattcataaaaatattgagaacttaaaaacttatttaaatggtatttatcttatggaatataaatattttataaaagtaatctttcacccatatatataatggatggaaaatcacatagtaacatcttataaacgcactaccataatatattgttaggtttttattttttattagcccatcatatatatgggataagcaatacataaaatagagagcaagctaaaaaattagaaaccaagtcctcttcgtaattgtgaccaagagtgagttcaagggataattcttcttcaccagttgtaccaccaccaacaacaacgacatcatgtctctattttcatttagtcccacttgccataaaatatacatctatttcgttcacgttaatgatcacatagtaacatcttataaacatttactagcataatcataatgtaagagatgcaaaggaaaataatacccttgacgattgatagagagacatgcaaagatactttcataggtttgttacttgattccaaaattggggttactttcttagtaatattgttcaggttcttaattttgattcaactttaagtgaccggtttaggtgctgtggttaagtggaattgagtaccggttagatggagccaattgaaacggattggagaaacaaatggaaaccttcttttcacgagagagggtcttctgttatgtttgggacttagtataaaagccctgtaatctcttcttcttcattatccgttttcatacttgtaaaaaaaaaaaaaaaactttgagctctgagactccattgttgagctctgctcttgctctgtaattctcgttctgatttagtgaattgccgaactgatttggccccagacgtagacttgatcatatcgatcttgttgaactgggtaaacaaactcttgtgttgttttctttcgttctctgtttcgatctctttcttgagctgatttgagtttcgattgttgagtgattgagagtttgtgaggatctttgtattgtgaatcgagcataaaacgtaacagattggtatcagagcccaggcttttgggtggttcattcacatcgcatcgatcgatggcgacgacgactagagttgagatcaaagccttcgacggcgataacgacttctcgttatggaagatgaggataatggcacaactcggagttcttggattgaaaggaactctaacagactttgctttgacaaagactgagccattaacgaagagtgaggagaagcaagtagcttctggagatgaatcatctgattcaagtgctgtgttgactaaagaagttccagatcctattaagattgaaaaatcagaacaagcgatcaacattatcatcaatcacataagtgacacagtcttgagaaaagtaaatcactataaaactgcagctacattgtgggaattgttgaatgaattgtatatggagacgtcgttaccaaaccggatctatgcacaattgaaattctactcgtttagaatgatgacttcaaagacgattgatcaaaacgtacgttgatgattttctgaggatagttgcagaattaggaagtcttgatatcaaggttgcaaaagaggttcaagcgattataatcttgaattcgttgcctgttacctctgatgagctgaagcataccttgaagtatggaaataaaactctatctgtgaaggatgtagtttcttctgcaaagtctcttgaaagagaaatggctgagcttaaagaaaacactaaggtggtgaatacagctttatacactgcaaaaagaggcagaccacaaacacgaaatcaaaatggtggtcaaggcaataaccaaggtaagaaccaaggaaaaggcagaagcatgtcgaattctaaatctcgtgtaacctgctagttctgcaagaaggagggacacgtaaagaaggattgttttgctaggaagaagaagttcgaaaatgaagaacaaggtgaggcaggtgtgatcactgagaagctggtgtactcagaggcacttagcatgtataaccaagaagctaaagagaagcgggttattgactctggttgtacctaccatatgacttcaagaatggactggttctcagattttaatgaaaatgagtcaacactaatcttattgggtgatgatcacactgttgaatcaagaggcactggtacagtgaagattaacactcatggtggagccataaggatgctaaagaatgtcacatttgttccaaatctgcgaaggaacttgatctctacagatactttggataagttgggctttaagcatgaaggtggagatggtaagatcaggttttacaaagaaaacaaaacagctctacttggaaacttggttaatggactttatgtccttgatggtcacacagttctgaatgaaagctgtaatgctgaagggccaaaaataagacaagtttatggcattgcagacttggtcacatgagtgtgaataacatgaagattctgactgagaaaggtttgattgaaaagaaggatatcaaagagctggatttctgtgaacattgtgttatggggaagtcaaagaagctgagttttaatgtgggaaagcacattactgaggacctactaggatacctacatgcagatctttggggatctccaaatgttaccccatctctctctggtaagcagtattttcggtctataatagacgataagtctcgaaaggtttggttgatgttcttgaaccaaagatgagacatttgacaagttctgtgagtggaaagagttggtggaaaatcaggtcaataagaagattaaagtgttgagaacagacaacggcttggaattctgcaatctgaagttcgatgagtactgtaaaaagaatggtattgagagacatcgaacttgtacctatacaccacagcaaaatggtgttgcagaaaggatgaatagaactctcatggaaaaggtgagatgtcttcttaatgaatcaggtctagatgaaagattttgggctgaagcagcctcaactgcagcctatttggtaaaccgatcacctgcatctgcagtagaccacaacgttcctgaagagctgtggctgagcaagaaaccaggctagaaacacctaagaaggtttggttctattgcttatgttcatcgagctcaagggaaattaaagcctagagctttaaaaggtgtgtttctgggctatccacaaggagtcaaaggctacaaagtgtggctattggatgaggagaaatgagtcatcagtcggagtgttgtatttgatgaagactcagtttacaagaatctgctacctgaaagtgataaagagcagattgaaggtgaactcggtaaagagactactattactgtcaatgacagtgttaaagaaaaaggagaaagttttgtttcaggtggagctattgaggaaatcagcgacagcagtgactcagaggctgttgctacagaagaagattcacctatacatactgtaaatctcaagaactaccagctagctcgagacagaacccgaaggatcactagaccacctactaagttgtcagactatactcattttgcttatgcgttagtaatggcagaaaaacttggtgaagaggaagaacctcactgctatcatgatgcaagaaatgataaagactgggagaaatggaatggtggtatgtatgaggaaatggactcattgctgaaaaatgaaacctgagatattgttgataggcctaaggatcaacaggtgattagctgcagatggctatacaagataaaaccaggaattcctggtgttgagtcaaagagatacaaggccaggctagttgcaagaggtttcactcagaagaaagggattgactatgaagaggtatttgctccagtggttaaacacatttccattagaattctaatgtctattgtagttgcagatgacatggaactagagcaaatggatgttaaaacggccttcctgcatggagagctagatcaagtgctttatatggagcagcctgaaggatttgaagcagatccaaacaaagatcaagtgtgtttgttaaagaagtccctctatggcttgaaacaagcacctagacagtggaacaagaagttcaatgctttcatgatggatcaaggctttactaggagcctacatgactcgtgtgtatacgtcaaagaggtcagccctgatcagtttgtgtatttactggtttatgtagacgacatgttgatagctggaaagagtatggctgaggttaataaggtcaaagaagggttgagtttaaactttgagatgaaagacatgggtgctgcgagtaggatacttggaattgatattgaaaggaatagagaggaaggaactttgtgcttatctcagtcgaagtacttagagaaggtcattcagcgttttagaatggcagatgcaaaaggtgtgagtactcctattggtgctcattttaaattgtcagcagtcaggaacaatgatgagagtgttgacacagaagtttgtccttactccagtgcagtaggaagtgttatgtatgcaatgatagggactaggccagatgtagtttatgctcttggtttggtgagcaggttcatgagtaaccctggtcatatacattgggaatcagtcaagtggttactaaggtatcttaaaaggtcaatggatctgaaggtggtttatacaaaaggaaaagacatgaagatacatggatctgtgattcagattatgttgcggatctcgataagagaaggtccataagtggatatgttttcacggttggtgggaacaatgtgagctagaagtcaagcttgcagcatgtggtaacattgtccacaacagaagctgagtttattgcacttactgaggcagtaaaagaagccatttggattcgaggtctcttggatgatatgggattgaagccagaagcagcttcagtgtgatgtgactctcagtcagcgagttgtatgtcgaagaacaatgcttttcatgaaagaacaaagcacattgatgtgaagttctatttcataagagacataatcgaagctggtgaagtagaggttgagaaaatccacacttcaaggaaccctgtagatatgcttactaaagtcatacctttgcacaagtttgaagcagctttagatcatctaaagcttctcaggtgatacttggtgatatgtttgccgaaggttaagttcaagtagtgcaattcactggagaatgatgaaagattgaatcaaggtggagtgttgttgttcttaattctgattcaactttaagtgaccggtttaggtgatgtggttaagtggaattgagtactggttagatggagccaattgaaccggattggagaagcaaatggaaaccttctttttgcgagagagggtcttctgttatgtttgggacttagtataaaagccctgtaatctcttcttcttcattatccgttttcatacttgtaaaaaaaaaaagaaactttgagctctgagactccattgttgagctctgctcttgctctgtaattctcgttctgatttagtggattgccgaactgattcggccccagacgtagacttgatcatatcgatcttgttgaactgggtaaacaaactcttgtgttgttttctttcgttctctgtttcgatctctttcttgagctgatttgagtttcgattgttgagtgattgagaatttgtgaggatctttgtgttgtcattcgagcataaaacgtaacaaatatcaaattgtaacctagaataaattaaaataagatagttactttactaaacaacaacaaaaaatgacactacaaaagccaaagttaatacttaatacatgaacagaagaacctttagtgatattgcaaaactttggtagcatcacgagcacgttcgttaatctgaaggtattgttgagattgcctcctctccatttgtgtatcattctcctttctgcataataaagttatggataaaataagatatatgccctaaagaccctatgtgttgtgtttaacatcattatattgtcctttgcaaagttacaagacaaacatatctactaagaggcgatttcggagtaccctcctcctcaggcggtccctactagtcttcctcctaatcggaatgtttgtcagtttgatgcatcttggcaccaagaggacaccttgagtggacatggttgggttctagtagaccaagacaatgtcctgtatttgggtcttaagagtgcgcggaagagcctatcaccactacacgctgaagtagattccttgttatgggcgatggaaagcatgatctcgataggtgtcacagattgctccttcgcatctgacagtgctgaccttatttctcttcttgaaaaaccttcggagtggcctacttttgttgctgagatggcgacttttggttcttttgtctgttttttcccttcttttagtattaagttcttttctcgtatttacaatgtgcgggccgattgtcttgcaaaaaaagcacgagcccgtaatagtttttttctcatgtaagcaagtcggttcctgattggctctctctagaagatagtctctttccgactacttaataaaaatggtgtttcgacgaaaaaaaaaaaaaaaaagacaaacatatctactaattttaaaatgaaagcgtaagtagttatttaccttgtatagaatctgcttccttcttatacatttattgaaaggaaacacatatatttgattcagtacacaccatcgtgtatgtatggctagcttacaagagcaaccccaatggtaagggacccttagagcatccacaatggtgagagccctcctatgggctctctcacattgtttagtataaattgtagaaatttataagaagagagcttatgttttttgaaaaaaataaatatagtccaatggtagtatctctcaagtgaggttctttaaaaaagaaaatttgaattgtagaaaaagaagaacaagaccaattatttggattgtattgtgcttttttggtgattgattgtttcacatagaaagcagaggacaattgtgagttttggtgatcgtatgttttgaggaacttgaagttggttttgagttatatatagcaacatggacacatggtgtatgaaagtattacatggcaagcaagacacattgtcattggtagagtaatcaaaagacatgattgctttggtttccatatattaagagctgagagttacatatcacagtactatcactatcaacatgaggattggtaactctagagctacttggatcatattctgctagaccagatttagattcagtcacaataacgtcttaccacttaagctcctccaaccaccttccttctcatgtataccttcgtgattcttcaagttgtttgttcctgaaatcgcataaccttttttaggacaatgcaaagaaaaggaatgagggaaaagtgatattactagttctctcatagttatccaatctaatagaagtgataggaataagaaaacaaaactttgcagctcctataccagttatgcctttgtttcaaggcctccactattattggctttcactgcataaaacaggtaatcaaatataacaatccacatgaaaccagaacttgtaagttacctcagtcaccaacaatcaatactcgaacttagccacatataggagctaagatctgctccttattaaacacgtaatttaacagtttgattcatcatctcattatcaacaagcacaacatcacccacctacagagatcttaatataagctaagatgtaaagtaaacacatttccagatgaaacaaatttcaaggtaagagagtacccggaaaatgtctttgagcagaaatttctcagattctccagatacatgattcatcattagacagacttcaaaactccatccaagtttgctacttccttgatgcattgaattggaaactctatggaaaacttaactgaaacttaattagaaaagagattcaccacaagcgaaatttactagaacagaaatgcattgaagagacaagtgtcaataattcaatatcctgcgtaatggagccaaatgtgtcaagttcttatcttgaagtgcagagtttgttaaatatcagaacatatatcgaagttcgtatatccaaattccaaacccaatcccaaaaatcagagtgggtatatgataagaaaggtacaaatcgaagaaagcttaccatagtaaagaaattagagaaacgttgaaccaaagtgagagatttagtgaagcgttgctgaagcatcactaagattgtgagcaggatcattggagatgatgagaacgaagaagcgaacattggcgcgacaaattgtgagagatacgcgaaagattcgcaagagagagaggaggaagagaacaaacgtgtgttttttttgggttaaaattatcagccaataaaagcttgacacgtatgcggctctctctcgtgctcaaaactctctggagagaggcagctctcttgtttattatgagtttagatttaatttttgtaaaattaattcaagagaacctttaaaaattagaagagaactccccattggagttggccttagggtctcttcatattttttttaatcataaattttgaaattttatagtttaaggaattgtgttggtctcttaatgttttgttcgtctaatggtaggtctttaagcggggtttttaaaaaacaaaaatattattgttaaattaaaattacacatattttttttcataaaatttaataattaatctaaatacttaaattttaaacatacatgatataaatattgaaaaccggaataacgatagttgttagcttgatttctgccaaatttgtgcagtataatttaacacataaactaattatgaaaaagtaatagtgaaattattaagaaatgattacttaaagtttgagtttttcatttaaaattttaaataattatcatttctacaatcattagtttaactgttttaattaacagttaatcttgaaaaactaatttaatttttaaattaatcttgaaaaaaaaagtaaaaaataatggaagaatagcaccttgttggatttggtagtagagcaggcccaactaacaatttctttgttttatttcaacaaccaataacaagtcgctacgtcaggatcccttaacattgaaaaatcccttccttaaagaaccgaccctgatcatttttgcaattttcttttatttttgggctttttggaaaggactatcacctttaaagccccaaaagaaacctgctctaatgtgtataaattctaaagatcaagagatgacttttcacttgtgatactgtgaggtctctcacgcccatatacctctcaaatttttcttcggaattgcacttgcaaatttaaggagaacaataacctcgtctatagtgaatctaaaaatgatagaaaagagaaattttgatgattgcaaggggaggtatcttaaaaggaaaacaaaaaagaagaagagattttgttgatttcaatggcaaaatttttatatttctctggatttatttcagaagaatcgtccttagttttagttttgcgatatgaaaaaaaatcgtttactccttttgccgccaaagtattcaacaacttgaacaaaacggcagctaagatcgtctgtccatcgcctacgcgacatctttgacgtaatgtaaggtgtaagtctctaatcgcttttttctctggtgaaactcttaatttgataatattctaaaatatgtgccaattatttatagaaaatgtctttaaaaatattaataattaattaatgctagtaaatgttttgttgtcactatttctctaaaaagaaatataaaattatacatttgtataattaactatttttaacaactccaagttgtcttttattaaataatagtatgaatgataaaatacaaacataaaaatagtactaccagatttctcttctttttattctaaaaaagaaatctatatatgatgaatgtttatataaataattaagaattaaccaaaaataatttatgacctatatataattacctatatataatgtatactgaaattaaatgaaacttttatacgagtgtttgtagtatatatatagtttgatttaaacacaaaatgagctatagtcatttgagtttaatcacaaaaaaattgtagcaagagagatcttgtacattacttacattaatacatatattttagattatttttaaaacactaagagaatcacttcttttggaaatttacatattatttattaatttaacatatagaaatatttgtttgttgttattatttattatattgattactgtataacaacctttaaaattttctccttatgtaaatttcatttaggagaattttctttgagacaggtaatgttaattaatacgtggacctacatctaaatttgctgccttatatataatacatattttataaaatttatatttgtttcctaagaaaagttctttaccaaaaaaaaaaaaagatgtttagattagagaaaagttcattcgaaaaatgtatgggtgtcaaataaaattaggtgttgttcgttaagcttctaaatgttgttgttggttaaattacaattaagcacatgtgttgggtaaagcaactcgattcattaggggaatgcatctaaaaaaacatacatttttggatgtgttttgaaggagagttcatctgcagtacaccgactaaattttttttttttaacacacaccgactaaatttataaatgtttaaaataatctcatttacaatcataacttaaataatcaccaaaaaaaaataaaaaaatagaaaaaaaagtaataaatcataacttaaatattagttttgttttaaaaaaaacaaagcatatcaatttctatagtcatgacccatattttatgtgaaataactagatttactctctctagttatacctaactagaatgacttacatcttttgtaaaaagagctttcaatcttttttatttgtattaacaaaattaccgttttgattttttttttaataaaataactatcttttatatttcataataataataaaaacacattaaaaacttttgtaattcctcttttttattgtcttcttctccgtcgagcaaaatctaaaacccaaagagagcaaaatatctagagtcgtcttcttggtaagtctctgtctttgtttcgtcttctccggcgaatctgcatgagttcttttcttttcctttgcctctttggcttctcttgagagacttttagattttctttgtcttattctccttgacgccaccaactagtttgtcttcttagggcatctccaaccctactctattttagagtaaaaatgcaaaaatcttctccaaccccactctataattgactcaaaaatagagatttctgcagattgactctatatatagagcaactctattctctactctatttttgagttcaactttttatttatactttagtccctcaaatttaaactttttatttaatacatataattattttacaaacaacaattacaacacataattttataaacttaacaaaatattaagtattaaatttaaaataattttataaacttaacaagaaacaagtacctaatttaaaattaaaaacataaaaaaaccaaaacataaaattaactagtgatttaatagtctggtaaattgcttgtggatctgccaagatagtcaaaatattgtccaaatgaagtagatggaagaggagtttcttgatcttgatcttttcgttggacacgtcgtttttgtaaaatccgtccttgttcactctcaaagtatgctcgaatatgtgagttttgaaaggaattcaaatcacaaaataaaatttgtaatgttttattattgttatatgatgtaatggttttttaataaataagtagtgtctaatttaaataatatcatattttctggaaatgtttacaaatctataatatatggggtcaaattgtaaattatataattaaaaggtattagtatataaattagaaatagaatatttctaagaatattcttttttagagtagaaaatagagctatacactggagagaaatccatctctaaaatagagttactctattttagaggtggatatagagctatacattgtagatggtcttagccgcctacatgaaacatctgtttatctaggcctaatttctttgttgttcgccgacagatttaggtaagctttacatgattttgctattgtttattttgaaaacctaactaattggcaattcaattttaaatttttagtaacaatcattcaataataaaaatttaatattattttatttttagtattataaaaattacattgtaggttagaaatgaaaaactatgggcttattggtatgtaagattgatagtttaaaagttatggaatagcaaaatcattatatatatatatatatataccttttacaaagtggtaaattaaagtacaataatatatagtttaagtataaatggaagactaagatttactaacaaacaaaagactaatttaattgtattttagaggtaaacttaaatgattatagctagctagtaaaaaaaatattgtctcctttccttcaaaactcttttaccaaacattagagtgggtcttacaccatctccaatggtggtcttttgagaggctccggaaagatgagtcccttatgaaaaacacaaaaataaatcaaaaatgttaatattgttaagggacgccctaagcttagggatttttggagtgggaagagatccatacgtggcgttctctaattggtccatgaagtaaaagaaatcaatttttttctccttttttgttttattttcgtgatttcgtttttttctctttttcgattatttcgatggcgattgtatacggtttgtcgatccgtttgagcatatattggcggaaattaagctaactactaatcgttattccggttttcaatatttatgtcttgtatgtttaaaattttaatatttgtattaattattaaatattataaaataaaagatttacaatttttattctgataataatatttatttttttaagaaacccacttaagaattttaccattggaccagaaaaaaattaaggaaccaacaaaaactcttaaactttcaattctcaaaatttaaaattaaaatttttgaagaaacccaattaagggactaaccattggggtttctctatccctttcgactaagataaaaaaactaaaccctacttcttccggaaatcgactttccatatagtcatattgatcgttatgactagagagtcaaaaaacccttgagaaaacacaatttaattttgtgtttccaaaggccagcctaatcttgtgtaataatgcaggtatagaacccaggcccgtctcagcggggtggcaaggttggcaaatgaccatggttaataatcagtttcaataattttattaagactaaaaggcccattttttccacacaaaaaaaaagtactaagagattttattctattttcagttttgcgataggtcacataatgaattgagtcgtgattagaaggttcatttctccagtggacggatctctcatcatgcgctcttcggctatccccaataagcaaggtttctaccaaataataaattcaatcgtttggaagatgcgaaatctgaaccaaataatatgatgtacaatgatttaatttaatatgagtaatattcttatattttcacaccatatatatatatatatatatatatatatatatatataacataataccattagtagtcgtttttttgttttttgagttaattgaaagaaaaagaaaaaaaacagcacaaacacaataacttgcaacgatttacactaatttacaagatttatttatttatgtactttttcttattatcttttttggtaagctactttttattattactaggttttaacccgcggtttaccgcggacaatcggtttatttggttcttatactaaatatttgaataaatttgatatcctaaacttataaatataaatttctagtgattagtgaagaatcgtaatatatgatttggatattattgattattgatttcgtgattgaatatagtgtttttagggatgaaatgtgatatattttgatttcaaaaacgacatagattccttatttttgttgaacggtttatattgaagggaaataattttattgaacggtttagattgaataggatcataaaagtttaggaaattgttaagaccaaattacccataatgattttgaatagcaaagaacaaaatccaaaattgaaatcaaaattgacgacaaattagacaaaatttcaatttgtactttccttttaataataaagggattattgatacatgcatctacaacatacttccaacggtttctacaaaaaaaaaaaaatcaaaatcaaaacatgttatgctttgagaccaagagtgagctcaagggacaattcttcttcactttttgaaacttttattgagtttagtgacaaagtaacctcatcatcattagcatcctcatcatcatgttcatcaacaacattaccatcatcttcaatagcaacaacagcttcaccattttcatcatcatctctcgttttattttgtggagcctgttatttataagcagtataatataagagtatttctaaatttacatgtatatattcggaaatcagatgaacacatagatgacttgtacacatggtaaatagttaaataaatgcatatgaaaaaaaggataattactctggatgtttcatagagagacttgcaggtaaagtagtcacttggtacttccttagtttcattacttgattgtccaaatgttataattttttcatatattcccgcttcttgcctacaagaaacttttattaagaaaatatatagctctctgcttcacgttaaaacctatatatatatcaactaaaatatttttattaataactacacgaacctttgttgattttggaaaaagttggcattgccctgaagacgttggtagttatgaaggtaatgttgaaattgccaccaagttacttgtcctgtcactctaacacttctctttgctaatatctcttctgtcaaagattgaatgtgtttctatattatatacatatatgtataaatcagtttatatggtcctatatacacatgtacaatacatacatatttatataatttactttaagatgtaatgatcatatttatcaaccttgcatggattcttcaagcttcatgcccctatacatctgttggaagttgaaagatatatggttcaatattcaaaccagaacttataaaatatgatactattcatatatacacatatataatgatatgtataaagacatatgcttgtataagtatatggatgtatatagatattaaatgttaggacctggagatgactcttcacatgtgatattgtgagtcctctcacatccattaactgtaaaaccattttaggagttgctcctgcaattttagggattgtaaaccgaattcatttatcttgaacttgaatgaattcaagattggtaaaaattatataacttcacaagaacagaagttttataattgataaagtaatcttcaaaagttgttctatatataatgacagaaattgtgaatgatttttgaaacatttaagagaaattaaatcataattatagttttaggagaagagaaaggaaaccacttactattttctccacctagttgttcaacagcttgaacaaaagagttatgaagatcagagttccaccgcaaccgcggcacttttgatctaacataagatctaacgattgggttcttcatctgttttatatcttactgaaactcgcgattcgatgaaaattcaccaatgtttccggcaagctgttttcaaaatggttgaaggaactcaaagagatgagtttcaccccaaaaaaaaactcaaagggataaagccaattaattgagaattctctgttatcaaataggcaagttttcattgactacttgtcttcatctatcccttgtcttgtttttatatttttcgtttttcctagacaaaaaatagaaatagatatttaaccctttgtccaaaaaaaagaaagatattaaaccctaatgctataagaaatatgtttatgctgcttttttcaaaatcagttcttttttatgtttgtccttgtgacaacttctaagaattatatcagtttgtattatcaaaatttattctttctcaaatacttgcaatacctaattaaagaaaaaaaaacgtctattgaaaatatcacttataaaagagccacaaagtaaattagactaattatgtgtgtgattggttcgtctgtaactgtagattttttgctgtagaatttttgttgtatgtgtgatgactgtagctgtagattttattgctgtagaaattaggcggtaggttttattagtttaatattattacttgaagaaattggttgtaaaaataagattattgttgtatgtatttttaaacaaaaaaaatattattggtaaattgtactatgtgttatataatagaattcagaaatatcaatttaatatatatatatatatatttatatatttatatattaaaaacaatgtaagttatatatatgtcataaagtagtagtatttatatccataaagaattttaatatatatatatatgtatgaaaactgtagtaatgttgttaaagaaaatgagaaaataaagtgaaaagaaaaagaaaaaaaaaaaggtacagactttataaagaccattaaattgtgctttagaaaaacatgaacttacatacaaaataattaaaaaaattatttgggctgttagaaaaaatagaaaaactaaagcatgattgtttcaattttgggactgtaacttttttagtagctttaaaaatttcttacagcccaaccaatcatagcctatatgacctaaagcttcatgtagaatttttttattaaaaatatagaatataaattgattattatgcttttaatatttcagttgtattcaaagaaaggaatgtaatataaacgcaataattttgttttaaaaaacttagttcttggattcgatcattcgaatattaaaaaaaatgttgaacacatgtttaatcaatactacgtcaaatgataattaatctagtgtaatgtatctacttgaatagtattctagtatagtttttgattgttaaatgtgagtcagctgtgagtataaaaaaaatatttttggaatctgaaatttcatatattttataaagtaaaaggatgggctttcaggttttggcataaattctatgtagaggttaccaactattatgatgccgtggcaaaataatggtcaaaagactgaaaataatcacttttaaaatgtggaaaaaacaattgaaattttgcaaatattaaagttaaactgtgataaataaaaagtatgcatgaaccccacttaatggaaaaaggaatttaaaattttagataaaggttttatagtaatacctaatattatatatgtaataactaaaatgtacttattatatatgtaatatctaatattgatggtttttcttacatgtctttacactaagtggtattttataattaatataagcagaaatatattaataattgtatttctgagacaaaagtaattatgcacacagaaacagaaattgtatgtaattctcatttgagatttgtaactgacgctacttccttgatccttctaagtctccccaacaagacaaaagaacctggtaagtcatgaatactaggtcttctttagcggtatatggtgaataataaataatttttcttacaaaagttgaatgtgcactaaatttattctagtaacaaaaacattagtacacatgcatcttaattatttatcatgtatatctatatatgaagaataatatttatcatgtgattttgaaagacaataattatgttaattcaatgatataatatctactaaaacggtaatatgtatattaattattaaaagttgactttttatgggtatatatatatcataattaatttggattttggtaccacatcttactataacactgattagtgacagagtctctcaatcaccagcataactgacgactcttcaccaatcaaaattgtaataaatagtttaatggaatgaacgaacctgaacaaacagaatataaaaatagtatttttttgggcatagaaatagttatatatttgtccccatgcacgaacgttacaccttatagggaagcgtttgcatgctttttagcgaacagactcaaattatttcaattatttattatagtcaaccaaaattctcattccatttctctttgtcacttatactaacgttattatttaaatatcatattcatcaatttctagagaatttgtttcacatgtagaagacgtgaaattaatgtatatacacaatggaatttaaactaaacttgaaacaaaccaaaacatatatgaataatgcatgatgcatctataatagatacgcttttaagcaaccaatagttctgcatctattctagtagtttcgggttcctttgttatgatcatctttatactttaagctaaaaatcttattatgatggtgcatgtccttagattctgaaatattgacaacttaacataatggagttaattagccaactaaaaagtaaccaaacaatatgacgtgcgagcatatttgcatgtatgggaatcctcatgcgatgacacgtaacacgttcaaaacaaaaaagtctccgtttcggattatagaatattcaaagaaacaacaatattaattgtctattgtccgctaacgttatattgttatcctagttatttcatcagcttttttataatgtatttacttgaatttgttttttaaaaattcaatagaagaagtcatttctctcccatattccatatatatatactatttatgtcaaactaaacttcatactattttcagcatttgcttttcatactattttcagtaagtatccgatcttttaaaatttattttattttatcttaatatttactttaagatactacgtacttagtatttgacataaataccaagagaattaagtgtctaacgagaggacaaaaaagaatctgaaactctttagtgaggcgcttacatcatcacgtttttccaacatcgtcgtcgcattttttttattcttcgtaacgcatgtattaattttttcttgtcagtttaccggaaaaaaaaatgaatgactttaatactattttggaaataaagtgtagtagatatatctacttttttaccggaatatatagtctaatagcaattttagttaatcccacgcagtgactaaactgagcatggtttagctattagatcatatacataggtgatatatttagattatcaagaattaaataattttttaatagattaaacaatagacttagatcttagatctgatattgtatcagtgtagtgattcttttgatattaagtatcagatgatgtggatgctcataattcatctgtaaaattcgtttttttctataaaaaaagaaaattcacgatagtctttctactgttttagctaactagctacattttccccgagtaagtaattttgcaggcttttcgtgattatgtgacataattttacagtaattttgtaattctatgtttttataaatttattttttgattttacaaattttttttttaataataccaatatcgatctcaccactaaaaacaatttattatcggttctcaaacaataaataaacattaaaattaatactaaataattgttaatgatattcataagatattaactatgtgcatgataatcacgttacatatcctacgttcctacttctatcatccaaaagtcgcgtcggaaaaaagtgccgtgtctatgtttgtttttcttttgttatttgttggtttttttttggtgtggtttctatagacttttcttttaaaaaagattacagtccaataagaaattgaaatagtaattgggctaacgtgggttagccagagttacagaaagagagaattttcggtgaagctaatcggagtataaaaggaaaaactgtcaagcttttatgcaattttctttcatcgacctattgagttgccggtgattgcaataacaacgaaatttcagagttgtgcttaggactgcctagtcctgaaattttggaaaccaaagttacaaaaaacgtttttgaggttatttcctaagatttagaaaacatgggttctttatattataaaattaaataatttgggcctattttatactgtaaaattttaaaaacaaatcagaggcccaaagtcaatgtttcacgaggctctgtttaggaccggccatgtccgttttgttgatggatactaaattactaatgacctaacgggtttatttagaccgaaatagttttattagctaaaaccagttttcaaatggtttgtgaattgcagcatgcaatgtgtgagcatgatttcccaattgttctatcagtgtcaaagtgatatgggccaatccgaacgttttatccaaatggatcaaaagttttgattttataagattgatgagttaaattagaaattttgaatcataatggactaattatcaagaaaatgacactggtaatacatttcttaacacataatttttcctatttttataaacggaatctgaccataagtataaagattgatagaagttttttataaactattgtgtatatcacatttgtttaggaaatatgttagtaagaccttggtccaattggttcacctgatagtcaaaaatgtgtggtggtccttcaggaagaagtccaatctgaaacattttgggccgtttctagaagaactgattggatcagctgatagaattttattaaacaaaaaaagactatttgtatattgatttcatttttagttcccgagaagagtagaacaaatgctaaaatgtatcatgcggcccaataaccaacaaaactagttgaaagatggatcaatggtttttacatgaagaaagcccaaaccatacactaataatctaatattctattaaaaggacttgctgttattcggcccaatagccaacaaaactaattgaaagatggatcaggggctatggaatacctcagaataaaaagtgttattcattgcagaggaccccttaagcggacatggttgggtccttgttcgacaagacttagtcctccatcttggcctcaagagtgctcgacgaagtttatcaccgcttcatgcggaattttattccttgctatgggcaatagaatgcatgatctctattagcgatacttctggcgcttttgcttccgactgttcagacctgatttctatcattaacaatcaagaagattggccgacattcgcagcggaattgacatcctatcgctccttagtttatttttctccttcttttcgtattagatttcttcctcgtagttctaatactcgagcagattgtttagctaagaaaactcgggctcgtaatagccttttctcccatgtaagcacatcggttcctgaatgattctttctagcggagagtctctttccgataacttaatataaatggtgtttgatgaaaaaaacaaattatcgtaatgatcctaaaaaggagttagaaaatattaatatcttatctacatctagatgataattgtttttatgatccttattagatagtgtttaaatttaattatccactaatttaagcataaactatatattctatcaccgtttaaccaatccatataaatctcttttaaagcttctagaaatgagtctcacacatcagaaattagctattttcttattttattacaagaagagaaaaaaacaaacaaacaaacatgtgttactctcattttgccacatgcattataacgtataggtaggtgaatcacctaacttgtttcagcttatgtaattaactttaccaatatattaatttattgttgataagtatattttaaattaagatatgggaccagaaaaataacaaaagtttctattaaaaaatgcttgcatttaaaagagaagaatgtataaaatctttatcaaaaaaaagagtatatcatagattcataataataaaaaaaatttgataaatgactttttatttaaaaacttaagatattacaagctattactctctttgtttatttttaattgattttctaacaaaacacacatattaagaaaacatattaaaactgattataaatgtatcgatttttgtgatttatatttttctataattctaaatcaatgatatttaattatttgtgttgaactttaaaatttatcattaataactaataattagtgcatagaaaatctaaaaatcaatctttttgaaacaattttttttctaaaaaatcaattaaaaagaacagagagaatattgttttaataataaatgttttattggtaatccaatattaaaataattatatggattaaatttaattataaattttaaaaaatttgaacaaaaaattatttagtgaattgattccaacatgtggaaaaaaggaaacagataattaaaaaaattgattggttctgccaaaattgactaccttcaaatcagagatgattttaaaaataaattcatccaattaaacttgccacatcatcaacttggaccagaatattcgcagtcaccaaaaacaaaccaatgtgtccaggttcaatgaatctggaatcacctggttcttcgtatttttgttatataatgccacgcttctcacaaatcatcttgaattgaaaataaaaaacgaagaatcaaaacaaatcttagagaaaacaaaaatccaatttttgctgtgaagatggcaatgtctgtaaatgtttcttcttcttcgtcttctgggatcataaactctcgtttcggtgtttcattggagccaaaaggtataatttactttcaattctgagaaatttcaatttgttcgtccgaaatctgagaaattgtttgatgggtcaatgtgggttttgattatcacacaagaaatttgattaatttgggtatgaattgttaaaagtttcgatttttttttgtttcttacagtttcgcaaattggttcgttgaggttattggatcgtgttcatgttgctcctgtgtctctgaatctatctgggaagcgatcatcatctgttaaacctttaaacgctgaaccaaagacaaaggattcaatgattcctcttgcggcaacaatggtagcagaaattgcagaggaagttgaagtggttgagattgaggattttgaagagcttgctaagaagttagagaatgcttcacctcttgagattatggacaaagctcttgagaaatacgggaacgatatcgccattgcatttaggtatatatcgatcatgagatttgatataagtttgctttttgatagcttttgaagaaagattgctgatctttgttttggctcttgtgtgtttgcagtggtgcagaagatgttgctcttattgagtacgctcatttgactgggaggccatttagagtatttagtttggatacagggaggttgaatcctgagacgtatcggtttttcgatgcggtggagaagcactatgggattaggattgagtatatgtttcctgattctgttgaggttcaaggtttggttaggagcaagggattgttctctttttatgaggatggtcatcaggagtgttgccgtgttcgaaaggtgagacctttgaggcgtgctctcaagggtttaaaggcttggattactggtcagaggaaagatcaatctccggggacaaggtctgagattccggttgttcaggttgatccggtgtttgaaggtttggatggtggagttggtagtttggtgaagtggaatccggttgcgaatgttgaagggaatgatgtttggaacttcttgaggactatggatgttccggttaacacattgcatgcggcagggtatatatcgattggatgtgagccttgcacgaaagcggttttaccgggtcagcacgagagagaagggagatggtggtgggaagatgctaaagccaaggaatgtggacttcacaaagggaatgtcaaagaaaactccgatgatgctaaagtgaacggggaatcgaaatccgctgttgcagatatctttaagagtgagaatcttgtgactttgagcaggcaggggattgagaatttgatgaagttggagaaccgtaaagagccttggatcgtcgtgctttatgctccgtggtgccccttttgtcaagccatggaagcatcgtatgatgaactggcggataaattggctggaagtgggattaaggttgccaaattcagagcagatggtgaccagaaggagtttgctaagcaggaattgcagctcggtagcttccctaccattctggttttccctaagaactcatcgagaccgatcaagtatccgtctgagaagagagatgttgagtctttgacttcgttcttgaatcttgtccgataagtaaaccacaaaaccagtcgacatttctatgaggaataagaattatatcttcgtctcgttccagattgctagaacagatgaagttggtgtttggagaatcaattcaaagctttggatcacaaagtcagagataagctctgctacaaagcttgagtaattgcagtattgtaagatttataaagttgcgatagtgttgattcttcatgtaaatgtgtggtgtctattaaaatcaagcctctgtttcttctttgcattcatttttgagaatatagagctaagaaactgatgattctccatgaaaatcaagaccatgattcttcgtattcatatcaaattatcatcatatactaagatacatttcaaagctgagatcaggaacactaagatacatttcaaagctgagatcttcaggaacactaagatacatttcaaagctgagatcttcaggaatcagaacgagtaaacaatgctaagcaactgattattctccatacaaatttgtgacactaagagaattcaagctctagtttcttcacattcatataaaattaccatcaaatacaaagacattacctcaaagttgagtctcttaagagtcaaaaccagagtaaacaccactctctctcaactgtctcttctcttcttcaacataattcttgcctctacttgcttgtcccaaatctctcttcttcttctccttctgtgaaaaagagagattcttcctatcattccgcaactgcgcattcgcaatcgtctcgccaccagtaaccgcagcagctcttgtagcttctcgttcttgataactttctttcacttcctctactctttgtttatcctttcccgtagtccatgaccaatcctgtttctccatgggagcaggaatatcagaaagaccaacagctttgtaaccatgctgctgcagagattcatagtcaaaagctttcttatctttcttcgcaaacctcgctgcaaccgtaaaaaaaaaaacaaagttacataaaagagctctcacaaagttaaaacaatgaagcttttctcctacctattggcttcttgctctttctcttcttcttcttctccccaatctctgtattatccacatttgaatcagaagcagaagacgatgatgattcctcagaagagtcttcatcatcatcatcatcatcatcatcccatcgcatcaaacctttcttcatgataacaactctaacacagaattgaattctccattagtccaattttacaatccaaaaagctcaaaactttaagagagaaagtattcaactttcctgatttctcttcaacgatttactaaaatcatttcccaataagacaaactcgtccagcaattcgaaaacaaatcaagtacgaatctttgtaatcgaattgagaaaccctaaattgaattgaaggttcacgaagataccacaaatctaattagagtataacaaaagcttcgtaccttgccggtgtagttgacgaaggtaggagaacgattcgcggcggagacagcaacagtcgcaagatcagaagctatactcggtccatgtccgtagaaccaagagaataatataagtctcgaattttccaattcaatttttggtttgtgcttggtttggtttggtttttttcggttaattcaattttaggatttttcttcggtttagacaatttagctaattagtaaattgatcagacgaacttatcaacgttgatgatgatattactatagaggttattttattcaatggcaatagagaagatgcagaggaaacaaaacaaagaaactagagagtcaaattagaatcttgtttcaaataccatcttcaaatgcaagagatagtaagagagctcaaaaggttaaaccaagaaagtaaaatgacattattaaggtcgacgagaatgtacaatcatcaagaggatcagacgtagaagctgaggtaattagcagtagaaagatccaccaaatgtgttctctccactgtatgtcatgtagagaaacccgtcttcgtctttgtgttcttcgtagattgcagacatcaatgccgctgtttgtaagaaccagaaaagagagaaaccatatttatacatgaaccatagaagtagaagattcacacaaggtttaaaaagtgttaaaatcctttaccagttggtggtaatgtgttcttgacaaagacaaagatggctttttcagctccaagcttgattcttttcctcacaacgtacacaaattggccaatggttagatcagctggtacaagatacctaaagagaagaaacaggtgtcagcaaaaaacatcaaaaccagcaaaaaataatgctatgcaattcaatctctgtatctagaaactgctaaactgtaccaagggacaagttttgaagaatgagaactatagttagactcaaaatttcatcagctagtgattaaaaggattaccggatcatatcacatttccattagactcaaaggagattgaaagctaatttgtgatttgataccattatgatccaacaagagagatagagataatatgtaaaacaaattactcacttcttcttgtcaatgtcaggaacatcactctgtccagctttttccacaatcacctgtattgagttctctaattagaaacttagggtgacactgtaaatcttgttccgtaaagtgagagtttagaaaacatacgggaactctttcagggtatttcgctctgatacgagtagactcagccattctcatctctgaaaccaaaacaaaaccataaaaaatcagtcacaactaacggattatacaaacacatgaacacatcttagtgacatgtaattcaagtaacttccaggaaaattccagaggcacaagtactaaatctttatagattcaacaacaaactaggtctaataacttaatcgtgttaatgtaaatcaatggagaatacaaacagagtaaccaatatcagagatcgagaatcagaaccaacaaactcgtgatcaggctaatcaaaacttgagttcctttaacaaagatcataatcgtaacacaatccaaagcccaaaagatcgaagaaaaccaaagaagtaaacaactatcctttaaacgcttatcgagtgacatcaatcaagcaaaaaccctacagaaattgcaaaaagtaaaaaagaagaaacaaggaaactaacccagaggattagaaagcttgaaggagttcttctccatgatgattcggttagtatctacgatgattaagagaaacaaaactcgaaactttatctgttaggctaaatcgggaaaaaaacccaaaccacaaaaactcgaaattgacaaagtggagaggcgaaatcaaacgtacccaaaagacgaaactagggttcgatgatgatcagaggaaaaaaaaatgaattttgattgtagaagaagaagaggatcaaaaaaatgaaaaaaggagagaatatatataaaggaaacagagaggatggatttagggtttagtgattgttacctgcacggcacccaaacttattacttggattttaattagttacgatgcttatcttacgtcagcgagatgatacgacgtcgttggattgtagtggtcatgagtttgtgaactatttattgggcctttataggtttggatctcgtttgggcttttctgtcatttacatgatcaggactactaggcgtggacaaataaaccaactcgaatataccgaatcaaaatcaaagcaaaactaattaaatcaaagcaaaccaaaaattggaaaatattcgaatggatactaaattctataaatgaaagaaccgaaagaaccaaaactaaatggatactaaatattatttatttttagactacataattaaaaataattgaaaagatatataaaatagtaaaaatactcgaaaaaataaccgaaaatattcaaaaatgatcgaaaatatccaaaataaccgaaatatccaaaaatattcaaagcaaaataatagaatggatattaaattttaaaactgaaaaaaccgatacgaatcaaactttcaaaataaccaaatgaatactaaactttagaaccgaaaaagttgaaaccgaatagatacaaactgaaaccgaatggataaccgaactattaggactaaggactacaattaacaattttagtttgttccgattgataccaaattaccaatcataaagacataaaaagggtaagaaagcagcagaactgaaaactatttctaaccactatttttatttatgtcaaaagtaagactggtaaaaaacaaggttagaggttttaggtatataaaaaaaacaataaacaataccaaaatagttacaacttttttttgttaaaaaaaatagttacaacttttttttaaaaatctcgtttttcaacgttttcgtcactagtaataattagaagtttagaacggtaaaatactgcaaccatacgagattaccaatcaaaatctaactatttggttcgcctactgttttttttttaccgtgttgttttactactaatcataccaatataaaaatctttgcttctactatcaatcctttttctatatttaaaagcattattgaagtctaatgtgatgttttctcgttacattattttcttctcgatatcccatagttttaaagtttattacatttaatcaccttttttttggtctcgttcactcaccgctattaaatatcttataactataatcaaacaaaaaaacattcaaaactattcataaaagagttcaaaggaaaatcatggattcaatcctttatatgtacaccttcgatatgtgaatatatgacattgatcgattgatatggttgaaaatgtcttcagaattggaaactcagcattttagggcttatttatttttgcatgaaatcggctaaattaatgatatttagtagcagatttgccaaatacataattagccaaagatggacatagctaatattaacaaagaaagaaagatatctaatttatatataacattgtcgatagcaaacgacaaaatctttcaccaaaacatggtaaagaactcaactccaattaaaggttctaaaggagatgcccctctctaggctctaatttaagatcataaaaaaaccttcaaagagaaaccaaaaacaacagaagaacataaaacgggacccatgcatggggctgacaagtcatcatcatcactatgatacttatctactctaaataacacattgaaaaataataacaacaataaagaaaaaaaaaacttaacaaaaagactcttggtatagtgatccccacatgatgatgacgacaatgacattgataatgatgatgatgtggataccataaagttgagtttttcatgatgataatgttaaacaagagttatgggattcatattccatgcacatggatgataattatggtgatgatgatgatgagatattttatcctacttactccaagaaaccagtttttgacaagacagcatttctcactttgcttagatctcttcctttaagtgttcttccaactccttcacacatagagaaagaagagatctgtgttcttgctagctttcttgcaacccattcatgtggaggaaccatgcaaccatcatcatcttcatcatcatcgtcagcagcatgagaatgcaaatggctactccttctgttgctctttgagtcaccataaaccttggaccaatcagggacattcataggtgctgatgattgtttcactcctgagacctccttgcttctacgaatgttccatggtgaagaggaagaagatgatgaggaagagaaatgacttttgggtattttcatttcaggacttgaagtttctccttctcgtaaaactgaccacacatcttcttcttgaaactcttcgtccccttctattcccattgaaggaaccctacggctattatgtgtccttcttcttgatcctaatgaatccattgtgagagagagagagagaaatcaaatcaccagttgataataataataagtagaggaagagagaaattcttcaactactagtgaaagttttcttgctttttaaagagttttgttgttgatgttgttgtttttgagttaagtgagaatatatatatatatatatacacaaaataagataaaagaaatagaaaagtcatatacaagtctgggtaaataaaccgaaccgaatgtaccgaactgaaaccgaaacaaaaataactaaaccgaacagaaaattggaaaataaccgaatggattctaaattctacaaccgaaagaaccgaaacagaatggatacataccgaaatattttggatatccgaaaagatccgaaatagtttttcaaaaatattagttatttttagactaaatttaaattaagttgaaaatatatataatatattaaaaatactcaaaaatggccaaaaaagatatccaaaaaaattaaaaaggtctaaaataaccaaaaatattcaaagtaaaataaccgaatgaatacttaattttaaaacaaaaaaaaccggaaccgaaccgaaaccgaaataaacttttaaaataaccaaatggatactaaattttagaaccgaaaaaatcgataaccgaatagatacataccaaaaccgaatggataactgaatgctcaagactatacatataaaataaatattcaaagatttttacaattgacaagagcctcttagagaaacagaggtttcagaaaactccaaaagagtaataattttgtactcttctgttctttctgcaataatttgtgctaaagacctaaaatgctttaaaaataaataaataaataaacagttgcattacacaacttacaagagtaagtagcctttagtactattttctactgagacctgccaaatcattgacagagtctgattcatacaataagacaaaaaattgtactatatggaaaagacttgcttttatgtcaaattatatttactttttccggtaaaattttaagagaactaggacaaaaatcaatgttatcccaaaaataagaggacgaaattaaattcagctcgaaagtggctttaatgatgttacgaaaagtgggagagagagagagatcattttttggcttcttgcattcaatttacgtacgatttagtaaattaggttaggttcttcgttttatttactgtatgaaaatggtgactgagtgtaatacacaaaaaataatgttttgaaaacactaaaagatctaaaaaatgcagaaacattagagcatgcacatagttatactctatgagtattattaacaattttttagtattaattttaatgtttatgtattatttgagattttttataatattggtaataaatttgtttccagtgctagaccgatattggtatcattaaaaacaattactgcaaaatcgggaaataaatatataataacataagattacaaaattactgcaaaattatatcgcataatcacaaaaagcctgctaaattactcactttcagaaaatatagttagttagctaaaacactagaaagactatcgaattttttctttttttttttgctttcagaaaataacgagtttcacatacgaatcatgagcctctacatcatctaatactaggtatcaaaagaatcactgcactgatacgggatcagacctaaatatattgtctaatctataaaagattattttatagttcttaatactctaaatgtatcatctatgttcatggtcttagttcgccaatataatgatcgtgtgaaagaataatggatttagaaaaataattttcttcaaggcagcaaaatttaaaattttcaaatagatttatgaatttaggggaatgaatacaattgatatagcttcttaataattgacgtatgaatatgatactgcagcatccttgcaactagaatctaagttatgtcttgtcctaacacctaagaacaaaatagtgaaatagatacattaaacttgcacaaaaatgtcaagacaatgtctctatccttttttttttgtcaacaaagacaaagtcatgtaagaaaattaaataagagcacatacgaaaaaaacatattagcaaacaacaatttttttttaaataacgacaaattagagtgttagaatgatcaaaaaatggtaataaatgtatgagctagttgttaatgttcctttaaattgacaaagctttgagatgaagaattgaagatataaaaaataaattgttctcaaattaattataacattggttggatataattatcacaattacatttggtgcaattactatattgatggcaaactattaaataataaactcaatgaaagtaaaaagagtaaagaatagatacaaatacaattcaaaacaaacaaaagaatgaatgataagaaaagaaaaaaaaatgattttggatcaagtcttaaactatactaattaattttgtatcgtgaccaagttaaactctaatatattagagcgtgggcttccaacctaaaaccaattggcaagaggtggagaggcccatatcttatatataccacttaagatcctactcaacttccgatgtgggacattgtccctaatacgccccctcgagatgatggctcttctagccattgatctcgatatgtttgggcatggatcggcgggccaagtattgggccggaccgatgtggatcgggttgagtatgtgcggaccgggctctgataccatattagagtgtgggcttccaacctaaaaccaattggcaataggtggagaggcccatatcttatatataccacttaagatcctactcaacttccgatgtgggacattgtccctaatataatatccgttgaaggattgagaatttttatctcatggttcaaaggtactttggaaggaaacttctttaatcttactctgatcacaaaggtctatgaagattacatacttccatcattcccatttggttcttttgtaggtgagagacgtgtttactatgagaaacacttcgaggtctgtttgatccataggttttgaaggctgattttggatcgcggtttactcgtgacaaaactgttggtattttgtgtcttctttctttaaagtgtgatttctctgttgttttgttctcgtgtttttttacactttattgtaatatctcttatgtagtaatttctggtataatatcatgttttttattaaaatgttgtaaatttttaaacatttaaccaaaaaaaaggaaatgtttttacttacttcgacccttgttaataataatagaaagttacgatggttagatggtcacaaaaattgcaatggttgcattttactgcactaaaaatatcacataattaatcttcaaaatgctatagaaagtatttgtgtgttgggctaggtttagaaaatattaaaattgaaatggagattaaattagatgatgaggagtggaaagtgatgtggacacatcaccctacacagtaaacacacactttagtttcagaaaccattatcctttttataaactcctctcaccaacacaattaagcttcttttaattactccgggaaacgagcaaaaagatcaagcacacatactcatgtaactatttttataatcaacagtcacatactaaacgagacattatctagacctactaattccaactattagattataccgactcggtttactccaaagaaatagaaagaatcaaaaatcaagacattaatgtagtaaagtccattgactaggtggttgtatctaatccgacaatttgtttaaattaaacggtgttgatcaaagagttttcttaaaccaatatttgattatatctaccgacttttagacatttgatgtaactaaaaatatactattagctctaaaggatttgtgggataaaaaaacatattaaatttggacaagccattttgtcagctttctcaatgcttcgtgggtttcccgatttatttgagcggatggtattttgactattttcgtttgagaccccaaaactttagatatttttgcatatccctcaaaattaagtttatatctgttaaaaactccccaaaaatcagaagacaatcagcttaattgttcttggattcatccgttagggggtgaaccaaaagattgttctaattgttatagttagaagtaagaaaactgttcgatattttggtgtatgagcaagaactaaatagaaaaatgaagccgttggattataggaagaaaattgttcgaacagctaattatatatatgaaagttggacaactctctccatatgagtgacacatcatcatacaagaaaatgacatgtattattctacattaattaaattaaaagattagcaaactaattgagaaaaaaatcaaaagtcttttgttgtgttaaattcttcattaatttcactcttaaataaatttctaaaaacattcaataaataaaaaaaatcataatattgtatcaagcactatttttattttattctacttatgttattaatttatttttatcaatagtcattaatccataatggctaaatatttactttttggatataattatattttggatatttttggttacctaaaatattttggtttgaatccattcggtttcggttctttcggttatagaatttaatatctattcggttattttcaaacttttggttcgggtcgattcagtttttttgcatcggtttcggttttgtacattcgattcggtttatttggctaggcctaagttttttaaatattacatcaacagtatatgatagaatgatgtgcaattatgttactaatttggtttgaaagttgcctaacttgattctaagcaaacaatttctttttgcatgtattctcttctaatttagtattccaatcacatcatgatagactcatgactaaatattggattgacatcatttaaacaacaaatatataactaactactcatttgctttaaaagttttcacatgaaagaaaaaaaagaaaacaaaaattaaatagtctttttaagtcaacacttttggagagagtgtcgtatatttaactttttggatatatctaatgtctcaaaagaccattacttaaaaaacatgcatgtcattattaatgttaccaatttatcataaagtacaaaaaaaacatattatgtaaaccaaaaaaatataagaaaaagaaaagactaagttaaaattactaaactaaaaatgcaaacagctaagttgcactacacgaaaatttctaatcgttatcaagtaatgactattaaaaaatataacaaaataagaaaagtaaaatgaaagtagtgtttgctatatcactaccgtctagaacaacaaatgcaacatgaaacctgaaatgcaaataaagcaatattagatatttgttttcaagttaaatgaatgaaaataggtaaaaaaatttgtataacccatcattctttaaaactttggattcttggtagttagtacaaagaagtgaattttggtgtggttcaagtgtgcctagacaagttttttgcatgggaagttgttccaaccatatgttgatagtacattcacaattgtagcttggcaaatgaagtatgaatcctacatttcattgtgattgtttgttttaataaaattaataaaattagttttacagccacacaaacctgttgtattcttgtagaagtgaattcgcacaattttgcaatacacgttggttccattttgggagtgtttgccgttacatccgtgatggtaaataaatcgttttctgaaacaccaaaactaaaaaagaggcttttgttatttttttaattttgtttgtaggtaaatataaattataaaataaacttaccgattaataaacttagagattggaccaatgtggtagttggaaaaaaaccttgtgtatatggttccatccaagcaaagtgtgcgtgcgtgtaaagtttaattaagagacttaatacattcatgtttagtagtaatatgaattttattagtgtattatttttataattataaaatagtcttaccatctagaattgttggattaacatatgttactaaaacaatagatgttagagacattggatcagttaggatggctcgaaggcgagaaacagttttagcccaaagaaataaggagacaatcacattgctgtagaatgtttaaagtaatttgtttaactatgagtgaatataattgaaatgtaggggaaataaatctgagactatcaaaatagaaacttacggttggagccataatttgacaatgatttggtttgttgaagtagggtcacttaagtttgagccttcgattgaaagaattttttcaactacatctgtattaaatttggaaattgttattaaccaagaatagtaaatatgtaagattcatataatacaaataatatttctattatatttataatttaaagctgaaactaatgttagtatttatatattattaaatagaaaatcatatgtttagtaaatatttaccaggtaatgcaagatttgtgttggcaaaaccaaccaggtgagcgtaattgtaaactttaaatttctctttctctatctttagccatgattcatataccacaatgattttggtatcaatgttgactttgatgacaaaagggtggtccgtgattttggtgtatttggtgcatgacctaacttcaaaccacaacaggtgattctgatgaagtggtttgatcggtttatgagtaaaggagatcaatgtccaaatagcatttgagaagagctttcgtaagacaattcataattgagccaccacaaaggcttttacatttgtagtttttgtcacacagaagtttacattgatttgtagtataatattctttgtacaaggtttcatatacttgattctgcaactacaaactaataataaaacagagaactcaacatgaatccactaacaacaattataatactttaccaaatactacaaaatacttgcagttaccaacactacaaaacagaactcaatcataaacaaactcaatcataaacaaaaccattgtgagaaaactctacatccgaacaaagaaacagatggtccacgagttcaccgatgctccacctcgaaccaggctccttaaccaaacacctcattagaaagtcttgagcttctgcagataaccgagtcgagatttgaggagtgagatcactatgaccaattaaatcaacccaatcatcatgaaccaaatcaccatgctctccccaaaccgttttccctgttagcatctccaaaacagaacatccaaacgcccaaatgtcaacagcaaaatccacaagcccaccgcctattaactccggagccatgtacgtagatgagtgcccgcgctacgcacgagattttgttgttgattttcttaaaatttttaatatatatttagtttatcatcttttcttagaaatgttatttttataagagagattgtattatgaaagatgaaaactatatatttgttattaaccactatatattgtttgttaatttttactcttatttagaagctttgagtgtgttggatgttggttcccattctttatattttgaggattaaattgtaatgatgtctaacatgtaatggttatttattactattgtttagaatactctaatttttttaatggttgataatttaggtggtgatgaaaccccatggtttgagtgtgttggatgttggttcccattcttgatattttgagaattaaattgcaatgatgtctaacatgtaatggttatttattactattgtttagaatacaataaattttttaatggttgataatttatgtggtgatgaaaccccatggtttggtactgtttgaatagtaacaaaagaaattatatatatatatatatatatatatatatatatatatattttttttttcgttagtatttgaaccgcaccgcacttaatttatagttgaaccacttgtctttattccaaaattaatttgtaggtgtattatatatactttttgtttggtattgataaatgtacatatatattgcgtatttaatctcccaacaggcatcagccatagcatcaagaaacttggtcaaataggccaaacaagcctcgtcacaccgaacatgaacagttagagggagaacaaaatcgctcaccttctccagatctttcagattaaaatcgatgtttggacatcatctatcgttttcttattattacgtttgtgaatatgatttatcatatgaacttttctgtacatttttatgcattctgataacttggtaacattgatatacaattttataacgtaatagtcatttgagacattcgacatacaaaaaaaaaatatgagacctatatggctatatgcaagggaaaagaattaaagcgttgacttgaattactagcatacgatgatgtgaattgtgtagttgatgacaagagaatatatggaataaataattgtttgttacaattaagttagacaagtttcaaaatacataagtaatataactacatacattgtatcaatatatcatatactgtttttgtatgtgatcatgatagtgaaataatagatatataaatatacatattatagtagaattgatatttcgagttatagataaatcttatcataaaatataagaactatattaaatagataggaatttatcaaaatgaacatcaaaatcaacaaaataccataatcatattttttcgacaattttaaaaagtgttttctgcaaaataacccttcaagtcaatcttgtttgcaagtttaccctccaagtccaaattatgcaagtcaatctcacaatctcaaaagtcacccgcaatacagccctcccgtgtagtgatgacatgatattcgatatttgtttttgaaaacataagagttttgtgcaaaaaaaaccctcaattttttcttttttgcaaaacaaacctccatgtcaaataaatacaggtcaaaccacaatctgaaaaatctcttacaacatagcctttccgtgtatcgatgaagtgacagtcaataactcattttagagtacgtgcaatgggtttagattttattagtcatttatctaaggtgcaatgtgcaatgagtagagtttatatgcaatgtgtaatgggtagaaaaatttaataaaataaaataaaaagttaaatttttgaatcgataacataattaactaaaaaaatacaaagaggaaaatattagaaagaaaatgaaaatttggttctattttgtaaagaattatttaatatttggatagtttgattatttaaagtatttgattgttttggttctaaaataattaatattttgagtttataattacagttataggtattaattttggatattttctaagtttctggatatttttgttaaccgctatcgactgccatgtcattgatacacaaaaaggctatattggagaagacttttcagattatggttcgatctgtatttatttgacatggaggtttatcttacaaaaaaaaagttacattgaggtttttttgcacaaaacccttatgttttcaaaaacaaaatatcgagtgccacgtcatcactacacgagagggctgtattgcggatgacttttgagattgtgatattgacttgtataatttagatttggagagtaatcttgcaaacaagattcacttgaagggttattttgcagaaaacccttttaaaaacaaaaacccatgctacatgggtgttcatctagtagtaatgtgaaattgacatggttaagaattaagttaaattcttacttaaaaaaaacaaaaaacaaatttaataaatttcagagtgatcattgatatgtcaacataattaaaaaagaaaagtgtaaaggaaaaaacaataacaaagatatttgcgaattatgataaaatatagaaatattctgttgtttgagctaggaacaaatcataaaagatgaatcaagcctttccaacgataacacatccacttcacttcattaattatttaatttactgtttaataagtttattaataatattgcattttaatatggaaaaataaataccaaaataatgttatatgagtcagattttactatgttatatcattatgtaagattaagagagagatggagatgtcccagacttggtggaatcccgtggttggtcggattggttatggcgtggctgtggcaggcttcagtggtggtggagggcaaagttggccaaaagaacaaaaaagaggaaacaaacgaaataaaaggtagtgtggaggaggcaactttggaggctcttcgacaccagatatgacgtatttactccaaggttaaagtacataaatgttcattagcatcccagtaatccatagcaactatcggatcttgaatcagatttatattcaaggagttatgtttattgcgttcaggccaagtaactgtagaatttgtcaaaccctaagaagctgttccgagatgggttattcgaggcgccatttggatgtcaaaatgttgtctgatatgcatggctgaacctttgtggagttactgatgatactaatagctaaagattcaacggtggaattctgttttgaacggttagttattgttttattcttatgtttctgagacagtttattatcgagtaaatggtgacaagttctattgttttatttggaaatgaggtttgtggatgtcggattcacatactcaagtatttatttgtttgtggaaaaaaatattcttgaaaacaaaaatcaaatgtaaaaagcctagaattgatattgaaatgactatagtatatttgctgaaaaaattgtgtgtgtcttacatggtacaaaaccttctttatttatacaaaaacctagtaattaatcctaattatatgccataattcccctttaatgcttctgtttcggtcttcgggttcaacattctaacgttcgaatttgaattaactttgatccttcatgggctttgctactcgacccacaacacctaaactgaattgctctcaactcggcttagcctccacctcgtgatatggtcacctcgcgatacctctcaactcgacttcgggactccttccaggctgtacttcctgcgggtcccttttttacttacgtggtaatcttttgttggtcttggactactggtgcaagatccgacaccaacaaaagaaaggaaacaaaagaattaaaagtagtgtggaggaggcaactttggaggctcgttgacaccagatatgacgtatttactccaaggttaaagtacataaatgttcattaacatcctagtatccataataatatagagcttcagctcagtccaacctttggaggctcgttgaacggttagttatttttttattcttatgtttttgagacatttaattattgagtaaatagggacaagttctaatgttttctttgaaaacgaggttggactgagctgaagctctatattattgttccttcatggtttgtgatgtatgcttgatggagaaccacgctgaagttccgataggttagactgtagcatctttaacaagttaaagactgtcttagttacttagtttaagattaagctgagcaagctatatattacattataagtaacatatatttgaatgatgatggtatattatatttatatgtggatatgtatataactatgtaccaaccgaactagtattaaaatgggaacagaaaatgaatgcgtgtttgctgatgatatgattgtgtgacatacatgccatttgtgataaagatcaggttcctaccaataaaagtctcaacattctgaaacagtctctacgaccaaaccatggaatgaaccagtttgtgagtactcaacgttcttctcacaaaatcagtgaattcttcttgggatttcgagtactcaagacacatattacaatactcaggagcaatcatctcataagatacatgttttcaatccgtagaaaagaaattacaatacaacatgatcaatttaaatattaaaaatcaatttgaaatctgtaattgcctatatgcatatttcactaaagttaaatctaatttagtagatttactcttattatgaacataatttagcaattatactacattcaaatagatatggtaaaagtaagaagtgagtacaattgtaaattgaagtttaacttgtgaatagtttgtacaaaaaaaaatcataaattaatgctctataaattcataatcactataggttaataattttgtctagtctcgagtcggacaaatgtaagatatttaacataattcacaaaaataataagataataatttgtttgaaaatcttgtgtaattatatggtcccattagtatcataaattaataattgtatgcacttatcaatatatatataatattgatatatgatttttttttagtaaaatatgattttagtattatttgtttttcttatatatgcattaattgttggtggagttcacttataatattttactacatcaatattttgtattgttttctagagatagtaattattttacctttatttagttttaggaggatattgatttctactaaaagaaaattcagatttaaacttttaagaattacaaaatagtcaaaattgtgtaaaattaaataactattcatttaaaaataaatattataatttctttgttctgacactattaatataaagaagttttactttattttgataaaacaaaaaaatcgtattgtactttcattatatatagaaaatcacgttttcataaataaaacctaatttacaatatttttttttaattgacacttaaataattccgaaagaaaaaaggcaataggccatttttcaaatcctaggcacgtccatgatcgttggtaatcaaaagaatgtaataggtggagaaaaagagagaatggagatgatgcatgtcttttataccaaaactatttagcctactgaacaaattgaggctcatttatgttgttaaccatgagaccaaactcaacgacagtccctaatgggctcttgagggttggtctcttgagttatatagcaaaaattaaatgagtgtctttgcaaactagtacgttttcgaaacttaattagaaaagtaatacagttactatttataatatacagttactatttataatatgtaatatagtcataataagttttttttcgtgagaaagagagagagaaacatgtcagagagagagagggtcatgttttttttttttttttttttttttttttttttttttattacatttctttccctaaaattttaagaactataatactcgtttttaaattttatttttctaaaattgatcgtataaataaaaatctctgtttttttctctatcatttgatatgcgttttgtttaataatttttaaattttatttttctgtaattgtgtaactaaagatataaatacaatttgtacagcataataatctgtacagcgcaatcagtacaccgcaatctgtgcggttgtatctgtacagtgctatctgtacagcgttgtctgtacaacactatctgtacagcgttgtctgtacaacactatctgtacaacgctatctcaaagaaaaacaatttttttagagagaaaacaaattaaattaaaatacataaccaataatacttggataatacataaaaagagttatacattcaaatacttgccactttgaaagaagtttaggtaatctgcaaaatgctatttgtacatcgctatctgtacacccctatctgtacagcgctgtacagtggtcaaatgtaagaaaattttaaaaacgtatttggtttcgaacaaatatatgtatagcgctatcaaatgatgaaatgcatctgtaaagaaggatattttttcgaaaccaaatacgtttttaaaattatcttacattttgaccactgtacagcgctgtacagatagcggtgtacagttagctatgtacagatagcgttgtgcaaattacctaaacttctttcaaagtgacaagtataactgatgatgtataactctttttatgtattattcaagtattattagttatttattttaatttaatttgttttctctctaaaaaaattatttttctttgagatagcggtgtacagacaacgttgtacagatagcgttgtgcagatacaaccgcacagattgcgccgtacagattgcgctgtacagattacgctgtacagattgtatttattctcttgtttaacaattacaatacaaacaatttcaaaattattaaacaaaacgcatatcaaatgatagagaaaaaacatagatttttatttatatgatcaattttagaaaaataaaatttacaaacgagtattttagtttttaaaatttgaggctaaatgtaataaaggaaaaaaataaaaaaaataaaaaaaaataaataaatcctgacccacctgacccacgctctctctcacacgctgactcattcccttatatctctctctctcaccaaacaaaaacaaaacgtactatgactattctactaattataaatagtagatatactacttttccaattaagtttgggaaacgtactattttccaacttattccaaattaaatcataattctgtttagggatttggttgagagggaagagaagaaaaattatgtcctgagttttttttcatttcgattgaattttttcctttttgtaatcttcaactattctacatatatgccttcaaatctcggtaatattatggcctatcgcccatgatttcataatcgggctatacatcaacaattgaaaagtgatttggttgaacatatattacaaaaatttggcgcgaatcaagctaacaactaatcgttattccgtttttgatttatatatgcttttgtgtcatctatatttaaaattgtagtatttgtattaattattcagttttatgtaataaaatatttataatttttattttaataataataattttcttaaaaaaatgcattgaagggctctatcattggacaaagaaaaaatgggactaacaaaaactcttgattttaaatttctcaaaatttattgtttagaaatttggaagagctcaaccattggggttgctctgacgctccgtgtcttttttttatgaccttaacacttgataaaatttgaatctattttgattgggagttactttttttgcagatggttagaagatggatgttgggtgatgatgatgatgatgatggtgatgatgatggtttgcttgattcacttactagctagggagagattaaatcatagaacagattgaggagcaggttggtgtcatgttcaacaacttatgcatggatcagatcaacaatgttatgacattctctgaatgaaccaaagaacatttgaaactttatgtaagatgctaactaggaaatatggattagaagagtctgaaaatgtttaccttgaggaatctgttgccatgtttctcgaggtggttggctaggataagactgttcgagatattgctgcaagatatcaacggtcattggatacagtgaaaagaaagattgatgatgttctgagtgctctattaaagtttgcagcggatacattaaagccacaagaaggtgagtttacaagagtaaaccctgttttgaagaatgatgatcgatattggcctttttttagagattgtgttggagcacttgatggaactcatgtcccggttcgccctccaagtcaaactgcagaaaaatataaaggtagaaagctagaacctacaatgaatgttcttgctatatgtaatttcgatatgaaattcatatatgcatatgtcggtgtacctggtagagcacatgatacaaaggttttgaattattgtgcgacgaatgaacctatttcccacatccgcctaatgggaagtattatcttgttgacttcggatatcccaccaggactgggtatcttggtccacatcgtaggatgcgatatcatcttggtcagtttggtagaggaggaccaccagtaactgcacgagagttgttcaaccgaaagcattcaggtttgcgatctgtgattgagaggacatttggagtatgaaaagcaaaatggaggattttagatcgtaagcatccaaaatatggtctgactaagtggataaagattgtaacagcgacaatggcactacacaattttataagggattcacatcgggaagatcatgattttttatagtggcaaagcatagaagaatatcatgttgatgatgaagaagaagaagaagaagaagaaggagaagaagaagaaggagagggagaagaagaagaagaagaagaagaagaaggagaagaagaagaaggagaagaacatgttgcatataagcctattggtgacagagcgatggaagctttacgtaacaacatcacgaacgaatgtaataaaggtcgcttaccttattagatatgttttttttagtgacttggtttattattttagttaacgattttgtctatcttttttgcttataacttggtgtactactttattgttataattatgcttatgatttttcacaaatttttatcgttataattacaaaagaaaactaaaaattataactagttaaataaaaaatgttatggatgtaactatatttagattacattttttttattcaaatataattataatacaaatttatattaagaaaataagaattaagttaaaactaacgcagcggcggcgaaacgaacatagatacttgcggcagcggcagcgtcggcggcatccaaacgaacataaatgttgcgtcagcggcagtggcgacgaaacgaataacaatctgcggtagagtttcccgctgccgctgccgcctgcggtgaacaaacaaacaaactaaataatgtcttgttggatatgcaattgaagaagataggaaacaaaattcttaacttttttttttgtgttttttagatacatggtaattcgatggcaacactacaagttccaagtgacgacgtgaggttttttttttataggttggagctcggttttacagcaccaacggagctcccacgtccccttcttcagttgattgaggtaagcgttaatacgccataattgaggctctcaaaaattggacgtacgtatagttgcggggacacgagtagcgatacttgggtttcacggaactgcaaagtctagtcttttgaatgttcttgcgggagatttagttactgttttgaatgttcttgcgggagatttagttactgtgggtgaagtgagaataagccagaacctgaggatcggaaggtactcttttgtggagaagcccacttggatatattcttcctagatctttatcctcctcacccaagaccaaaggaaatatattaaacttgatgcggtgcgtttgaaactgatcaggtttggtctcccaagtcaacaccattacacttcattttcacgattgtttgaaggacaaaaggctaaggttgtgttagcctccatctcaatgtccaacccacacattttgctttgttgacgagccaactaatcacttggacaagccaactataactgccttggggaattcactaagttggttcaaaggagcagctgtgttggttagtcacgactcgagacttgtatcttccgatgtacatttaaagactaccaaatccagtcagaggtattcaaaaaagtcttatgaaatcttgaaagatggggtgaacaaaaggattcaatgttgtccctaactaagatccttagtcataacaacaatggaaaaggattcacaactaacaaccaaagaaaccaaaatcttattcctccaaaggatcctacaaaaactcttcatcatccacaaatattcaacgaagatctccatcattttatccaatgaaaagccaaaatagatacaaccgcgtttttgtttgtaattgcatgattataaagagttctagagattatcaattatacattatacaaacgataacgaaaaaaaaagaagaagaagagagttttggactcatatagaagattcaaagagggttcaaaacaaatcaaacctgtgcattagctccagcaacaatctcaagaatctctccagtaatcttagcttgacgctttctattatacaccatcgaaagcgatttcttgagatccgatgcattatccgaagcactactcattgcactcattctagctgcaagctcactagccaatgactcctgtaatgccctaagaatctgactgttaagatacagaggcaacaaagcatcaagaatctgaacagggtcttgctcgaattgcaagatcggcgagaaatcagctgttggtgtcctaaaagtctctctttcaactgtcaatttcccttcttttgtcgttaacctgaaaaactcatcttccgcagcatccacacaggttccattaatgtcacagatctctcctttaggtgataaaggcagtagcgtgtggatcacgggttctgatttgaccaaagagacaaactttgtgtacaagagctcgactttgtcgacttcttcacttataaacagagagaagacatcatcagccacagcttgagcttctttagccgtaggtaaagttccggcttctaggtatttgtcgacggggatgtacgggcgacggaggaaataagaatttcccttcttgcccacgctaatgactgtgtattcaagacctagacctttaagctctttgattcttgcctctgctttcttaatgatgaaattgttgaatccaccacataatccacgatcaccggtgacgacaacgagagctactttcttaaccggtctgactttggttaagggaacatcgacatcatcggtttgaagctgttcgttgatgttgtaaagaacttcaactagggtttctgagaatggtcgtccattgacaacagcttcttgagctctcctgactttagctgcagcgacaagcttcatagcttcggtgatcttttgagtgtttttgactgaatcgatacggtctctgagctcacgaagagacgcttggagtggtgaaacagaggaagctcgtgaaggaggtgaggaagtgttagttgggcacttgagaacagatcggaatgataaggaagatgaatcagcagaaagagatggttttgatgaaacccacattgttgttagattagagcaagccatttttttgttgtttgtttcagacagtgttttgctctaaccttatctctctgttcttttgattgtattgtattgaagaagaagaaagaagagaggagagatttgagtggagggaagagaaggtgatgagattaggtttggagataaggttttacatttgctatttggagtctgcaaattgtgggatcctctttttgttgacgtggcgttgtattagtggatggttcgatatcttcaatgttttttttttttggggtgtgtggtatatatcttacttctttgtaattgtttatcagccaaccaataattgcttttttattttatgagttttgaccccaaagagagaaaatatctgacaaaggatagaaattagagtaattaggtttggtttaatttctttggtatggttttggtccattagtatatatatataccaatcaaattaccttacaatagacttaaaatgatatatatatatatatatatatatatatatatataatttgtaatctggtttgatttgttaattgcttttttattttatgagtttttgaccccaacgagagaaaatatctgacaaaggatagaaattagagtaattaggtttggtttaatttctttggtatggttttggtccattagtatatatatataccaatcaaattaccttacaagagacttaaaatgatatatatatatatgtatatatatatattttttaatctggtttaatttgttaattgcttcaattttctccaaaatttttttgataagcaaaactttatagagaaaaacaaatatttggttataacgaaaaaatcatatagtgtaacaactaacaacaatggtttcatttgttaattgcttcgatttattccaaaaattccgataaaataattctacagatcaaaacaaatattaaaaactaatatttggttagaaattagaacgaaataataaacatataataagaattaactaaattatagatataaaaatttataaaattttattcattaaattaattataagatgtttatatattaaaatcaataaaatattaattttatcatgaaaattgtagttttctttttggttaaaattatatattattgtatcttcaactacatccggatacatattttggaatatgcttattgttacaagaacataccgaaatcacacagaaaccacaaaaattcccaacctcttgctataaacaagttcttagttttatttgttttgttttattttcatcaccaaacatattattacgtacgctcagtttctcatggatttgtacaaactaatatcatctttattaatcaccaacaatctagtgacattctattcatctcttaaggatcaaatcgacctatgaatctttgatgcttacatgaagtaaagctcattattctttccgtcaattattgcatactcgtccaccatttcaaataatagaacattaaggatgctgaacatgttgagtcatacaccttattggatttagggttatagtaacaatctatgtaaaatctgcaccgtattaatatgaactcgttgctcgagttataaaagcccaaccaaacaaagattacacatcacaccagaactgactttaaaatgagttgaccaccctaagtacaatgaagattatgatccatcaaattcaacattttcagttgcctaaaagaggtagatccttagtggaaaggcaatacaaattgctactcatatgtaatatgcaagaaatgagtaagttcttttaagggtttgattattttattttctttcttttttatttctttgaaatggaatgatgataatgcaactttcaaaatatataagacttcttttaggtcacaaaatttgatgttagtatttaggtcacaaaatcggcaccatccacgcaatttgtgtcaagtcgattatgaaatgaatcaaaaccgtgcctaaccagaatgtcctgaatcgaaatccaaaatgcaaataccttacttagacaacaaaacattgatgtatcaatatatctaaaacaacaatagctattgaaagggggggggggggtggtggtggtggtatttatgtaaggtacgagccctctccatgtcagatccaaaatagcgccaaactcaaaaaaacaatcccgaaactatagatatcagtcttttcattaaagttatccaatttaacttcaatttcgggtgctttatagacggttatttctggttcactatagctaccaactttttgggcatcttccaccattttttttttttttttttttagttcataaatttccattcaactttaaaacatacaatggcaaaagcccaaataaaggccacatgcccaacacaggagaaaacaaaccttttcctgcaacaaacaaaaggggagacgaaacctgcaacactagaaaaccaaaacaaacagccctgaactagaacaacgaaaaccaagttcctagcaaggacaaagcgttaggttgatgagccgtgctgcgagacaaaggatccagacgagcgcgaatgatgagctggatgtccttcaagatagactcagtagaacgagagacgccggagtggagacgttggtttctttctctccaaattgcataaacacaagagtgaaaggccagcctgataatgagacaaatatttttttcccttgagggagataagagccagttaagacagtccattaattgggcaggaggattaaggttggttgaggctgtaaaaaacctccacacgacaccactaaactggcactcaaagaagagatgtgctctcgaatcgtcatgagcattgcaaagaagacactcagcagggatcgagagaccccaattctgaagcctatcccttgtgtgcaatctattccacgccacaacccaacaaatgaaggcgtgcttaggaacatggttcttaaaccagaccgccttatgccaggggacggtgtgagattgcggatgcagagcagaccaagttcttggagcggagaatctgtttgatggtgcatgaaggtccgttttccaaagaaaggagtcgtcatgctgacagtcaagcaaaccctgagcctccgggagaagatttttaagctgaacaatgattggattcctgctacggcttgatgcaatccaccaagacgtgccccttaacgcatccctaaccacagcatcaataggcaaaccaactgtacgagggcctagaggaccgattacctctataagggggccaaggccaatccaattatcatgccaaaacttagcggtgaccccggaaccaacctcacaaacaataaagggccttgccacaactctgagcttacacatcttccaccatcttggatatcatttcaacaccttcaaggacatcttcgtcctctacatgagaggaaaggttcttcacataagtggagtcgaatcctgtaattgtggagttaaaatagaaaataagacaaataatgaagtagttcattaaagagttttattaaaatgcgaggaaccaaaaagaaaaaatttatatttgttttagttcataaaagattgaatgtggctgcaccaataatcagctttggctacattaatttacacaacatatatatggacttatatatatgaacccatatatatatatttatatatatgaacccatatatatatatttatatatatgaaaaactcttattataaaacctaataacattgatttagatggactacactaatgataatatcttgggtttttatgtgtgctcttatactattgtcgattgtatgatttattcttcatcggatctaaagcaatactcaaaaaggtttatgtgtgctcactcaaaaccttaactaggggttcaacaaaacaaaacaaaaaaactcaaaggagatggatttcgagttgagaaaactttcaagaacattttcaaactctagaaaaaaggaaagcttcattctatgaatggagttaaatagaaaataagacatgaaataaagtgattcattaaaaagttttttttttctcataagtgttatactttattttaaaacttgtgttgtaaagatacaactgtggaaccttccacttacaaatcttgacagttgacacatattaaatcttacaacgttggatcaactaaagtatagtcatccatgttgcataaaaacaaacaagtctagcttataagcagatgcccataaagaaagcccagtccaggaaacaaaacccttagagaaagtaaatttaaagattgccttccacccaaaagccacgtgtgatgtgaagaaacaaagttgaaacacgtggactgaagaagccttagtcgtcgctgttcatcgccgaactggttagcaactcagagaactccaaaaccatggaaaccgccagagcttcaagagaagtctatcaatttttaattagagaaccccaccaaacttcatcagcaaatcaggaaaggaaagatctaccaaaggcaattgactcccgaaatccaaggaacatcgacgtagagtaagtctttgagctttcaacaacacctaaaaacaaacaaaaaagcactcgtctccataaaacggttagagaaatagccacaattgcattagattcaaccgagaggcgtaaaaaactttaatctgcaactcaatttgttcctaaaaaattgaaatcgataagcttggaaaacaaatcgagccctttaaacaaaggaggttcaaggaattatattccaaatggaaacacaaaagacctcaatcaaaccaaatataaagaaatcgagagatgaaaacataaatctaaaccggaaatcaatttggccaaaagctagacgagacaccgaagataggcggtgaaactctggaccttagctagcccaccgccgctaaagaagccaacggaagccagacgcaagcagaccaccgccgtaaaaaaccggacagtgtcagaacgaaaacagatcaaacgttgcccaaaacgtcgctggacaaaagccagacatccatactgaaaaagccataaattctggacagaaaaccggccaacaaacgttgaagaagcgattattgtcggaaaaagaagatccagtgcttcctctctctaaaagatgctgatgagagaagagagagaaccaccaagatttatttaaatgcaaggaacaaaaaaatgtttgccttcaaggataaaatagatatagatttaatctctttaaatttaatcttcgtcaataaatttgcttcatgagttaacgcgatcaaactaaaaaaatctttgttctctcacttagcagctcattttagaaattctcatcgccgttcgtttgccgtcccgtttctgttgggcttaagaacttctcctctgtagtatatcattatacttgagcggagcccttgtccgaagaattaccagttttttgttggagttctgattcagttggatttcatttgctactttcaaaagttggtttgctgtttcaattaggctcgattctctgtgaattgattgcgcttggtttcttatcgaagttgattcaagtggatttctcgtcatgaatatggagttagacaaagctatctttgagatgtcgatcaaagatgatggtcctctagttttatcctatcaaccaaagtttagttcgatagagaagaatagttgtagtattattcgacaatttctgaacccttctcaccaacgtatgtctaattggatattagatatgcctcgaatatggcggatctactcccgggttcatggggttgctctatttcaagagagatttcagcttttcttcaagtcagaggatgatttgcttgaaatttttaaaacaggtgtttggactcaagatgagtggtgtgttgtaatggatcagtgggtagagaagccacctgaggagtacttgatgttccttccgatttggattcgtcttcgtaatatcccagttaattattacacaaaagagacaattaaggaagttgtcgaatgtctgggtgaagtgttaaaggttgaattagatttggataaatctcaagctcaagattatgtgcgagttcaagttctttttgatgttcgaaatccgttgcgaaattccaaggatgttcaggtgcctacaggtgaagtgtgttcagttacttttgattacaagcgtatttgaaagagatgttttctttgtcaacgtcttactcatgacagagcggactgccctagtcgtcttcaaggtagtggtcaaatcccggatgcagtctcaaagaagttgtcttcagagaagatgacgagtgatcaaaatattcatcccacagagggatgaatggatgaatatttgtcaacgtcttactcatgacagagcggactgccccagtcgtcttcaaggtaatggtcaaatcccgtatgcagtctcaaagaagttggcttcagagaagatgacgagtgatcaaaatattcatccctctatgggatttgaggttaaagaagctctgttagacaaagagataacggagttggtgaggtttaaagagaagcagaaaggtgttgatgatcaaggaacaattttccccctttctaaatctactctttctctcccgataaatgaggacaagattgatgatttacagatgcaacaatccaaaaagttgcaggttactatggccagccaaattctgattatctgaatttggatttctctcctcttttgataagccttgttcttctggtttgtgcatcaaatagaaaaatcagagacctcggaaaagttatggagataaggaagactgcaatgagttcaccggttccaatcgataaagaggttagtttcaataccaagatttataaaaccttcaaacgaaagaatcacgtctctgaaattaaatcttctaaatgtcttaagagagatgataatacggtggttcctagtgaaccatcgcaatatcaatatggcatcttaagttggaattgccaaggtttgaggaatccttggataattcggcaccttaagaaaatgaagaaagagcatttccctgatattttattcctcatggaaaccatgaattctgatcagtttctgttaaaagtttttagatggcttggttatcattactttcatactatagaaccggttgggaagagtggtggtttagtgatcttttggaaaaattagatagagattgaatttctttttgaggataagaatcttttggattaaagagcttctcaaggaaggaaaggctagttttctcttgtgtttatgggaaccctgtgacgaatctaagatacattttgctggaaaagctaagtagtattggattagagagaactacagcttggtgtatgataggggacctcaatgatattttttctaatgaggaaaagttagggggaccggttaggttgatatcttcttttcagcctttcaagaatatgctgcttaactgtgacatgcatgaactgggaagtacatgtattggttttacctggggaggaacaaggaatggtcaatggattcagagtaaattggatcgatgctttgggaactcggagtggtttaatttatttccaaactctcatcaatggttcttagagagattaggatcagatcatcgtcttgttctagtgaagtttgtgaaagatcaggaggtttttaaaggtcaattctgttttgacaaacgctttgctgattttcctaactgtgcagatgctattcatggttcatggaatggtaaatttaattcttcttctatgctgcagatggttcattgtaggaaagcaataagtagatggaaaaagactagtgaatataatgctcagtaggattttgggattaagaaaagaactggatgatgcatagagtgagcagtttccttgttggccccaaattccagacattcaaaggcagttgggagttgcttttagagaggaggagtctttttggaggctgaaaagtagagataagtggctttttggaggtgatagaaactcaaagttcttccaagctatggtgaaagctaatagagcaaaaaattccttgagttttttagtggatgagaatggcaatgaaaaaactttgaatagagagaaaggaaacattgcgtctacctattttgagaatttgtttatgtcttcttatccggcgaatcttcatttggttttggatggattctgtcaaagagtttctgaagagatgaataagacttaactaaagaagtcactgaaatggaaatatactctactgtcttttctattaatgctgagagtactccagggccagatgggttcacagccttatttttcaagaaaaattgggagattgtcaaggatcagatatgcaaagaaattttgggtttctttagacaggggtccttcctcaagagtggaatcacactcacctgtgcttgtttccaaagatttcaaatccacaaagaatgtcagatattagaccaatcagcttatgttcagtcttatataagattgtttccaaaatcttgtctttcagactgaagaaacaccttccagcaattgtgtcatctacttaatctgcatttgttgctcaaaggttagtctctgataatatccttatcgcccatgaaattgtgcatagtttaggaacaaatgatcggattttcaaggagtttatggctttcaaaactaatatatcgaaggcttatgatagggttgagtggccttttttaaaaggaattttgactgctttgggattcaatgataaatggatttcttggataatgggttgtgtgacatctgtttcttactcagttttgataaatggtcagccatttgggcatattactcctgaaagaggtatcaagcaaggtgatccaatatcaacgtttttatttgtgttgtgtattgaggctctgatacatattcttcatcaagttgagagtaaaaggaaaattagtggcatttagtttaatggcgatggaccttcagtgaatcatttgtaatttgcagatgacactttattggtctgtagagcatcaaagcatgattgtgaagaggttatgctttgtttatcttagtatggacatatctcagacaaatgattaatgtagagaattcaatcacttttggtgctaaggtggacaaggataccaaacaatggatcaaaaatcgttcagggattcagatagaaggtgggactgggaagtacttgggattacctgagaatttgagtggctctaaacaggttttattgggattcatcaaagagaaattgcaatcaagattgactggttggtatgctaaaactctttcacagggaggtaaggaggttttgttaaaatcaattgctatggccttgtctgtgtataccatgacctgttttagactgtcaaaaggtctattaactaagcttataggggtaatgacggatttctggtggaactcgatggaatcttcgaagaaaattcattggattggagttaaaaattaattatgcctaagagcttaggggctttgtgtgagaccccgtcccggacgtctcggcgtccggcgacgttgtactcaaattcgcgcctctccccgaccgaaccgcttaatttttcgcgattcaacatagaattgcctttacgaggctaaattctataatcgctctcttattacacagcggaagtctttctaaccttggtttaattctaaccaactcttgtaccggttttcatcgtctttgtcccttagacttagatcgatcctttactcggtcaagacatgcatatgttcgctaaccactctaagccaaacaatcgcatattcctttatcctactttcacggtcaattaccaaacgtctatcttaactaataagctagatcgttacataccttggccaatatgcggatttgattccttagcccgtttgtcgccttactccattcgttcaacgactcgtcatcagtcgtgaattgatgaaccaatccctatcgttacttagccatacaaccaaccaaccccactggtctaagtacaatgatagagattggggatggtacgattctcttggttcacgatggccgaatcaagctcttggcttattggtccattcgttctccaaacgtacgcccctccggctacatggtggacgattgagccctcggcttatcaaaccatccatgtttccgttccggtcgtttaacactacgaccgcccacggtttactaaccaattacccgtccggtccatggtggtcgataaagctttcggcttaataatccatccatgcggtccgaacgatatccttatcacacccaagggtccgtggattcatccactggatcatcgtaggctagcccatgaaatctttcttccgtcggccttaggtttgctcgcgggtccaacatccgttttgttcatcggttcccaccgtggactttcccgttggttatccgtcgagtcaccctttggtcttaccgatctctgatcggtttcaccatggctgaggagatagatacatgaaggcggccgcgatgttgatcctatatggtgaatcacgttccttacccattcttggtgctttctccctttatcggtaagattgcatccatgggcgacccttgggtgtgttcggatgcacttatccttgtgcttcctcgaacacttttctcgatccatcccatccgatgatcggtctgtccgacccgttccgtcagacgatcggcctatcccatccgacccgtccgacgatcggtctgtccgatccgtctggccgatccgatccgtctgacgatcggtctggccgatccgatccaacgatcggtcgacccgatccgattcgtctctaagacgaacggtctaccctctccatcctctacactccatcgaaccgttggaccgggaggtagcatgcgcatcagttcggtcgagttatactcgccgagccgcaccccctttccgaccaacaactctaggatgtgttaggactcctttaagaatgttttatggtgttttggatgttgtgagatgatgtgagattattccaaaggccttgggcgtcctcccttatatagggggcgaatggatgcttcccgaagcatcacatccgttccttgcaccactccgaaaggtcacatccgttccttgcacccttccaaaaggtcacatccgttccttccaaaaggtcacaaccgttcgttggtacccgctcgaccttacaccttttggccgagacaccttttcacccgtgagctaccacagtccaccagctcgagtgtcagctgaccagaccacccagctgggtcagtacacgatcagctcaccgagctcagtcgagctgtctgtcagctcacctagctgagctagctagtcttccagctggtttagctcacctagcttagctagctagttcatcctagcttgtccagctcacctagctggttcagctttgaactttctcgttcttctgactaagtattttagtccgtttcttgaccatggtctagttttctcctaaaacaacctcacctctttatgaacgcgggacgtggtcgtttcaagtctaccccccttaaactgaattcgtcctcgaattcggcgtgtgtaagatcttgcttactccctaactcgggaaacgggcgttacactttggttttaaagacttgcaatgttttaatcaagcactgttggccaaactagcttggagattactcactgattcaaggagtcttctttctcaaattttcaaaagtcggtactttttaaattcagatttcctcaatgcacctcaaggaactagcccttcttatgcttagaggagtattttatatggtagggaattattgatgggaggtctgaagaggattgtacaaaggtgtggatttataaatgggtgtttgatggtcagaaccggagaccaatgaatgtgcattcattgatggatatctagatgatagtaaataagttaattggtcatatcactcggaattggaacttgctgatactcagagatttatttcaggagaaacatgttcagttaattatgcaccagagacctcttgtcactatagaagacttctattgtcgggctaggactaatgatggtttatatacagtaaattcgggttatgatagaagtagtagagcgacttacccgaatcctttaaagaagctgaggtatgtccttctattaatcccttgtttgataagatttggaatcttgcaacggctccaaagattaaggtgttcatgtggaaagttttaaaaggtgcacttgcagtggaggatagactaagatcacatggaattcaaattaatgatgggtgtttattgtgtgaagaggaactttaaacaattaatcatattttgtttcagtgttcttttgctcgacaggtgtgggctcttgcgctcattcaatcacctgcaatggcatttggatcctctatcttcacgaatattgattatctgattcacaattctctgaacttgggactttctcaacaactgagatctgttagtccttggatcctgtggtttttatggaaaaaaagaaataagattttgtttgagggtacatgttcattgactcaagaaatcgttgattaagcttatgagaattgttctcaatggatcaatgctcaaggaaaagggtctgttatggttaagtcaagttcccagaattggattcctccaccagtggatgaacttaaatgtaacattggtgttgcttggactaaacagaagcaattagctggtatatcttgggtggttcgagattcgatggggcatgttttacttcacagtcgaagatcatattcttatgtacactctctatttgttgcaaaaattaaaagttgggaatgggcattagagagtatggatcatctacattatgataaaataacctttgccgcctcctctcctaatattattaaggctttgaataaaccaaatgacgggcatcggtcatatttctgaattactcaagttcactaaggataaaccacactggtttatgatgatgaaaacagattattgtaatacaggtgcttttgaaatagctaagagtgtcatcacaggaatgcggtggcaatcttatgtagctcacagtttcccctattggttgagaagtctttttgataaggaattgacttatcaatagagtatttgagttttcacaaggaggttaggattagattttaggtttgtcttttataagagtagaaatcaaagttttttttaagtaatgtaaaatttgatacaaatcgataaattaataagagaataatttttttgaaaatcttatgtaaatatatggtcccatcaatatcataaattaataattgtataaatatatcaactatatatatctattatatgtaagaaacttcaatgatatataattctagtattgtttttttcatcttaaattcatattagttcttgtttgaatttagttcatttatttttattgtatcaaaaacttttggttttgttttttagacataataactgtttttacttgtatttggttcgaaaaatatattttatatatagagagatatattatattgtcatagaaaaataaaaaattaggaaattaagaaaatttatctataaattaatacctctataaattaatagaattttgcggtcccaacattattaatttatagaggttttacactatatgcgttgtgtcttaggtttgtgtttagtatctaaaactcccttgtgtttctcttttctctttggtatcatggcagatgagttatgggatgcattacaacacttagagttaggaagggaggatcctgctctgtttattccgcatgctacttatgcaactgttgaatctaggaatagacttagcttgattgttaggcctcttaatcctcgatctcaaaatctcaatgttgtggttgctgctttgccaagggtttgggatctgacgtctagagttcatgggagagtgattaatgcaacgtttgttcagtttctctttcagtttgaggtggatctcttgtctgtgctaagaagggaaccatggctctacaacagttggtttgtcacggctcatcgatgggaggtaaatatggcttttgagtacttgtctaatattgatctgtgggtgcaaatgtttgggatccctctcctctatgtttgtgaagaaaatgtggtagaaatagctcatggtttaggggaaataatatcattggattttcatgatgctactacaactcaaatagcttatattagagtgagaatccgatttgatattactgattgcataagattcttccaacgaattacctttgattctggtgagactgcgctgataaggtttcaatatgagaggttaagaagaatatgcagtagttgtttcaggctgactcatcataggaatttctgcccttatcaacaacctgagcctaggtctcttgttcgtggtcctactaacaaccttacaaggactagaagagaaggagtgtgtacccataatgaatatcatcgatcatccctgaactctcaatcgcatatgtctgaaaactcctttccagcgcctcttgaacctcctccaagagtggcagctccttctttgaatcctcatgaattggtggctgcttattttcctcaaggaagagcagtgtctttaccaaatataggaacactgaatctaatcttaatccatcatttagcagacaagcggtttcaaggaattttaacattcaaccgttttttggtcctgttattgctacaaatgttcctcgtgtggttgaagtaggtgagtgttctagacaaggagagtttggagaaccagtaaacaagatggataagggagactcaacaaaaaggaagaatatgggaagtgctagaagtgatgaagaagaaagaactcatggagttgttgggcataaggatggaggtattctgaaacctccaaagaagcgctaaacactctgaaaattttgtcatattttttgttttctatgctgcttaggatccatgatcgcagcttcaaggtttatataataagcgctgcattgggttcaagtatgcaggtccaaggtttgaataaggtgaagagtgggtatggccgttggaacactttttggttaaggctactctttgtgtgcagtttgttgtttcagtttacctatcactttttgattttacaacatgggtaacattgatgttttgttaggtcatgtttctttacttgttttggtgtttgtcttcaaactgaaagtggaaggtctactgatgtactttttgaactatgagagcagccccaacggtaaaatacattctcagtccattgtttctattattttaatcatttaagtataattttattatttatttatatttttagttacaaataaaaaaattgatcaattatactttatcacatataaagtgagtttttaagtacagtaaagcaaatccgtctttttaggactttctttctttctttcttacttctctcttactttttccaattaactatcattttttttctttttaagggacttattaaaaccgaccgctggggctactctgatcttaatatatatataaaaaaaagttgctccatgagttagcattgattacatttatcaatgtcttacatgggctacactaatgatagtatgttgggctttttatgtgtgctctagtagtattgtcgtttgtttgtatttgtactatgactcatcctcttgttcatcggatctaaagcgccactcaaaagggtttatgaaaaggttagggttttaacaacaactcaaaaaacagagatggatttcgagaagagaaaagctgcgacacttgcttcaattcgttcatcagtgactgataaatctcccaaaggttttctcgacgaacccatcatccctctcctcgaaaccatcaatcatcacccatcttacttcactaccagttcctgctcaggtcgaatctcaatcctttctcaacccaaaccaaaatcgaatgattcaactaagaagaaagctcgtggcggttcatggctctatatcacacacgacccagctgattcggatttggtaatttctctccttttcccttccaagtcaaatcagattgacccaattgaccaacctagcgaattagtcttccgattcgagccgttgatcattgctgtcgaatgtaaggatttgggttcggctcagtttcttgtggcgttggctatatcagctgggtttagagagtctggtatcacatcttgtggtgatggcaaaagggtaattatagctatacgatgctccattcgaatggaggttcctattggtgatacagagaagcttatggtgtcaccagagtatgtgaagttccttgttgatattgctaatgagaagatggatgctaataggaagcgaaccgatgggtttagtgtagctttggctagtaatggtttcaagaatccagatgaaaatgatgttgatgaagatgataattacgagaatctagctgcaaatcatgactcaagtatcaacaacggaaacttgtatcctggtaatatttgtaaatccctatgtgattgttgattttttagatagatagcttgaataatgcaatggaattggtcaagttacagtcttcattgtagtgttgaattatagtcttgtttagtttatactagtgtttgagttatgtctacttggtttgcaggataactttcaaattttaaacgtgatagccagtttccgtatctaaatcattggcaggggttcagaaagaacttataccactcgagaaattatccattgttggggaacctgttgagaagcttcacctttggggacactcagcttgtacgatagatgaatcagaccggaaagaggttatcgtgtttggtgggtttggaggttttggtagacatgctcgaagaaacgagtctttgttgctcaatccttcatgtggcaccttaaagttgattgctgtcaatgaatctccatcggcacgacttggccacacagcttcaatggttggcgatttcatgtttgtaattggaggaagggctgatcccttgaacattttgaatgatgtgtggaggctcgatatatccacgggtgaatggagctcacagaggtgtgttggaagtgaatttcctccaaggtatgagtcatttaatgtgtccatttcttcgacatgtatttgacctatttccagtgattaacttctatgtactgtttattttgttaaatcaacctcaacttctcggagatgccctccgagactagtaatcctgttattgcacattttgcttaatttcttggatttattatatatgtttttgttgcttgttgcattgacatcccttcagataattgttatctcaaattttcttctaaatgcaaattctttgaatttgagcaggcatcgacatgcagcagccagtgttggcacaaaagtatacatattcggtgggctttacaatgataagatagtttcctctatgcacattttggatacaaaggaccttcagtggaaagaagttgagcaacaaggtcaatggccctgtgcgcgccattcgcatgctatggttgcatatgggtcgcagtcattcatgtttggaggatacaatggggaaaatgtactcaatgatctatacagctttgatgtccaaagctgttcttggaaacttgaagtgatttctggaaaatggcctcatgccaggttttcacactcaatgtttgtttataagcataccattggcataattggaggttgtcctgtctcacaaaattgtcaagagttgactttgctagatctgaagcaccgattgtggaggagtgtgagattggaatttatgaacaaagagttgtttgttagaagtacagccagcattcttggtgatgatcttatcgtcattgggggtggggctgcttgctatgcttttgggacaaagtttagtgaaccagtgaaaatcaacttggttcaatctgtgactatgagtgaaaatcatcttcctccccaacctgaagatgtttctctagaatcgaataaaaacaatgcagatttgaagactgagacgtctctgtctcaaccatgggtgatacagctagaaagaaagtatgcaaagttcggcaaggacatacttaaaagtttcggatggttagaccttgagagaaaggtttactcaaacgaaaaaggtctttgtatatgctttcctgtgactgaaaacttttctgaacttttccatgagaagcagctattgggcaaggactttgaaaggtcagaggaaaataatctaacaaagggtctatcgttaaaagatatatcctgctcagcggctttgaatctattgaaggaacatggtgccaaaaaactcattaatgtagcttttgaagccaaaaaagttgcaaaatcccccttacagagaatgagagaagatatcacatctatacttaaacagaaaggcctaccagaagagcttttggatgagctcccacagaagtaagtgttccagaatcctgattttataatactcggggactaaaatggtgagaatctgattgcgtgcatgttgtttttgcttccatctgataagtaattggtgttttatctactattagatgggaacggcttggggatattgttgtggttcctgcaacatcctttaaagatccaacttggagctctatcaatgatgaagtttggtgtgctgtttctaaatcgcttagtgccaaccgccttgcacgccaagtatgttacttttagaagcttacaccaatattctataagtggaaacgtttacatcttttcatcttaaagccactcaaaacctacaatattgatttattataagctgtgagaatgctgagaactttacaaaccgttgtcttacccaattgcatctccttagcagtaagacttataccatcaattttgtgtctttttcagggacgagttgaacctaatggtacaagggatagtacattggagattcttgtgggagacaatggatgggttaatcaccgtgaaaatgggatcttgtactctttcgatgctacgaagtgtatgttctcatggggtaatctctcagaaaagcttcgtatgggtaacatggcctgtgaaaatgaagttgtcgtggacctgtttgctggaattggatattttgttctcccatttcttgtgaggtatatgccattattgaataaacgagaagagaaagtggttttatacaatcaaaagtcaatactttattagatcgcatgcaactacaatgcattcttaattgacatttacagggcaaaagcaaagctagtatatgcttgtgagtggaatccccatgctattgaagctcttcgacgtaatgttgaagcaaattctgtttctgagcgttgtatcattcttgaaggggataaccggatcaccgcaccaaaagtacggttgatgatattccaaacggctcaccgtctatttaattctatgcaaatggttctttttataactgttggatcgagtaaatcgctgaagtaatagattttgcgtttcaaatcttttgattctcagggagtagctgacagagtcaatcttggtctcatcccgagtagcgaaggaagctgggtcacagctattcaggcattaaggtgattttactttccttaaaacttattcttaactacaagaaccaggagcataaaatctggaacaagttttaaggttcagtctctccaaaagatataatctttaagacgattcaaactcagagatgcgaaaatcttaagccacactgctcttggaacctctgaatatgatccaaaaatgtaatcattagagagagcaaccgctcgattgaatgtatattcactgatgtctctgttcttgttattggaatttgtaggcctgagggaggaatactccatgtgcacggaaacgtcaaggactcagatgagagcagttggggcgagcatgtcaccaaaacattaagtgatatcgccagagccgaaggtaataagtttatgaacaaaatcgaaagctatttggactaaaaaaagagcattggttttttatcaagactaggagtttactaggacttatatttttttggggttttatggtttaaggtcgtagctgggaagttacagtggaacatatagagaaggtgaaatggtacgctcctcggattcgccatcttgttgccgatgtgagatgcagatgatgctgattgctgacaataacgagaatgcagcggagagacttcctatagtattgtttagcttgtacgatctcaatttcgatacctggtttttcactttttcactctttaccaatcccaagtaatcagttccccagtaacaaaccgacaatttgttccatataattttcctcaaaaccggtttccgattggtgtatcttctataataaaaaggttttggtgtttttaatttagattcttgcaaaacttctttgaaaatggatctctttggataatagatgatcagtgtttttgcatcctttattaagcctagctctctctgcttatggttgaaagttgaaactgctgcagcaatgatacttgctgagcaaaatgtggcagctgaaaagagtggcttagctacaagtaagaaaggcttgaccttgaaggatcttctgccacaaacttcacattgcaatgccaaacttcgcaaaggtacttggttgaggaaaatataatggtttgctttgctatgttgatcaattttagattttggtctgtgtagatgcattaaatggtctcaaagaccttttgaagaaccatccagcagagctgcagtcacataaatatgctatcattcagaaacttagggaacgaattatggatgatgatagtctagtgagagatgctctttatcaactatttgaaagtgtgatccttcctgcttgtaaaaatgtattaattagttcttctctttggataaaacttgcatcgttactagttaactgttgtgtctaacactcgaatctatgtgtgaatctattcaggataaccagagccctatggtgtcacttttaatgccatacatatcttgcgctatggctcattcatcggttggtgttcgttggatggcttccaaatttgaaaaggtgactacttagattgatttcttggattctgatacagagtgttacatttcccaacttttgcctctaatgtttcttgccacgacgttccctgatatttccatgtgctacttgttgcagattcttgaaaactacaaggataacaaacacaagtattttatccattcacaacttgcaagtttatccatttgattcagattgacgtattttcttctaatctttacaagaaacagaaactttttgtttccatccatttacagattttgtttttttctcctaaacctacgagctcacaccatggccaagggatttctagatactggccagtcaccatcgcataacctcggccaagggagtacacatactactttagaccaaaacgtaaaacttgtcaagatcattacagaatccaaaaccagtagtgtatctcaataataacatatgtatagttgatttcaaaatacatggtacaaggaacaagaaacacaaagaagaagaaaaccagagtattaagaacacaaaacaaccctctttcttattctggaaccggaataacacttggaacatacacatagctacaaataaacgggttactgtaccgtgactcttcatgtcgtcctgtctcaatttgttttcttactccaccttcatcaatgtggtaaagagtgatgcaagtatagcactcatcatctgttgtgcaagtaaagcacttatcatctgtgatgcaagtataccatttatgttcttcatcttcttcggcatctccctagctcgcaccatgccatgatatttctgtgcttgccaatggagtatcccggacgagccaatatttggtaaacgaaacaattccatcacttaactcgtttgtcacccacacttcaatagcccttgacacttcttcaccatattgtagtaacaaagagagtctatctccacagaatgttattcaagatcatcacaatagtctatgtcaatatataacatctgcaatgaatttagtgcattaacatagttgatttcaaaatacaaggtacatggatgattcttcaaggatcaacaataaacaacacacaaagaagagaagaacaagaaacaaccctagactcttattctggaactggaatcagacttggaacataaacatagctacaaataaacgggtcaaggtagcgaaacgatctatgtcgtcctgtctcaatttgctttctgatcccacattgatcaatttggtaaagagtgatgcaagtataccatttatcatcttcctctacttctccctcgcaccatgccaagatatttttgtgatctccaatgaagtatcctggacgagccatatcaccatggcactgtaacaacggaagatgagggctagtgacgttaaaatacttggtaaacgaaacaacttcatcactcaacttgtttgtcagccacaccgcaatgtccgttgacacttcttcttctccaccaaagtctgtatcttgtagtaataaagggagtctatctccactgaaacagcctaatcgtccagtacaccctataggaggacaaacacatacgttcttgaaagtttccatggagaaatcaaaacgtagaataaacttctctttagtatcagcaatccaatacatattacccttcactgacacacctctgcactgagtatatacatcccaatacttagtatcaagagttctccacgaatcagacttaaactcatatatctcgcactctgtatcatcaaaggacataggaccagagaacctcacgatcttgtagttttcacgacatgtgttgtcgtatccaatcccaaagtaatcagtttcatagtaagagtccaacggttcgatccatttgattttcttcgttaccggattccaaactgcgagattggcctctcttgttcgttcgtaactcgaatcactacatatacatagcattagtccatcgcagtgaaccatagaagcaaacgaatgtggagagcgaaacacgtctgggactggtgaatctgaaaagattccggtcatcggatccatgatttgaactgtcttatgatcatcgattcttatgaatcgttccggagagtgatccaagtgattgtacatgaacctcttggaggtgatgatgccgtaccattgcttgcacgtagatttgaatcggtttaaagattcagcaggagtcttcttaagtatttcttctactaactcaaatggtagtgaccggtacacacgcttagagaaagccattgacgttcgctgtatcagagagatggattcttgaagaacaaggtttcgtgtttcctgcgcaattaggttaccttgagccccaaggaaaattgtgaaaagaatcgtgtgatcaaccgagccaaaacggttatgttccaaccggaccgatctaccaatcgaatcagagtaaccctaaatatcctctctcgttcccaagtaattgaatcctctgaatattttgtacgtatcactatttaatatcacaaattctttaattcaagtagtatttattaaaactccaggctagtcctatccttaataggagaaggaattatgtgcttatctacaaggaaattatacaattttaaaaggtatatatatatatatatatatatatttttaacgcatacaactgatttattgattaatagaatctgagtacaaagcacttgcaatatatggtggaattaagtttttttttctttttctcataagtattattttattgatatgtctccatttgaactttctgaataaagctacaaagggcataaaagcccataacagacagccatgaaataggcccattagagatacagttcaaggaacgtgtcagaatcataaagataagctgaggacacgtgttacttccacaatctctgctggatgagacttcaaatcacggtgaatcatagaacgtcgtcggaaaacgaagccgaacaacgaatcttcttttttctcaccgattatggcaatcacgagtatggaggacaaaacatcaatatactgagcttttaaccagctaacttaggcgcagaactgtcttgacaactaaatcgaaagaaacatctagatccaacaaagctatcaacacataaccttgttagaggccaccggagcagaactattaatcctcgaaataattgaacaaaagtagagacataaccggatctactggatttataataaccaaacagcgaatattaaacgtgatacgaacctcatacaccggacgactagaaaaaacgacgaagctggccaacgctccttatagaagccggatgatgccaaacagagggccagccatcacaactccggaagtcggagatgctggacataaaacccgattatatattgggacagcaaaactagaagaaatttggtcggccaaaggagatgcttctctcatctctgaaatattttagagagaagagagagagaagtctcatttctataagaacattactggtggaattaagttatgataaggaaaatctatatatagttattattcttttgttaaacgggaatatatttaatcagcaaagaatctgttaaatttttgtttttgcatcatacaaagatatgtttatgtacaaaatattggttaatctttagtctttggaatctccttaggtgagagaccctttttgttgacttggtgttgtataagtggatgttctgagattttcaaattttggtgtggcaaatttacttctttgtttatcagccaagcccaccaatgttaacgagttttaagtttcttctcacaaagattaggaaataggactcattcaaaggatagattgtatatggctccatttgtcaccctacttcagttgtactaaaaagtctggataattgtacttgtaacatatggatatggttgacaaaattcttatcccatctgaatttttctttcgtacggaaatgcatttttctttcgtaaaagtttccaatttgatttagaacgggccaaaacaaaagcgagatttccactattttcatttgggagtaagtgaataaaatattggaaataaacacacaaacttgtacccaagttacttgtaagttattataattttttttttaattggcatggtttcatttgctcgcatttctattaatgtttcgaatttaattgggacatatgagacatttttttacccaaattctcttccctttcctatactatgaaactaggatatgacccgccgtacaccatatattaaatattttattttataaaatagagtatttttttgtatataatgtttgttgttgtttgtgttgattaataatctcgataagattatgtacggtttttagtgagtcgtaactttacgacattaataactcaatattttataatctaagatttgacccatggtgataatattttaatttttattcataattaatttgtattataatttaaactctattacaattacacatttagatgtgtaaaaaaagagatttaacatttagaggtgtcaaagaagataaatacttattatgatatactataatgttgatttttaagacctacaaaaaattgttattgtttgttttgtttactatttaaaattgtatagttgtaatttgattgctaattttaggattccgtcaatgatatatattgtcttatattaattaacatggatccaaatccgtctcatctaaacccatgccgccatataaactcgtctcatccaaacctattttatcatataaacatgtcccctaatatcattttgttcttttttataaatttcttatttaaaatacatataattcgagtccatttcagaatatcaatctgacctaaaataaaacttaatgaaagacaaataaaaatattacatttaaagctattttttaactatcgttaatttgtggtaaatatttttgtttgttataataaacaaaataaggtctaaaaaacaaacaaaatattaaactacgaataaaggttccagatttcgtctttttggctgaaaacagaagaagaacaaaactcatattaaacctcccacactctttccattctcttcaaacctcgatctaagttttctttctacgtttataccagatggtttccaaaattaatcatttcgagcttcaaaatttgacacacagcagaagagaatgacagatacacacgatgaacaaagagaattcgagcaagatgtttttcaaccgaatcaaaatatctcatatttaaaggtttatttgctagtggaaggataaagctttgtatgactaaaagagtttctttctttggttaagaggttaattatataggtccttgagcatgataaaattaggtttcgagcaagcaaaagttttatgaaaatatgacaattacaaattaatgaagaggatttatttatttctcgtcaatttgactaattctttcatttatttatttttctttatttattcgattttataaatttttatgttagcattatttacggatattagttagcataattaagaataatcttaaccaactttgtttaattttttgtaacgcattaaactcttatagttgttttggaagatctaatgagaagatattcgtgaatattcggtgtatccgaatataattaaaatcaataatcatttaaaaaaagaatcaaagatttttgggtcaaaatcaattaaaacccgatccaaatagcttgagcaaatatctacttcaaaaatgttaaatagattctgattattccacccatagcaaaaaaaagaaaagaaggaaattttgcatcaataaccaacaaaaatcaataattcactaactaaccaaaacaaaaaaaagtggatgtattttctatataatatttgccattaacccttgcttcttacaatcactcaactcttctcttttactattctactagagtctgtgcgggttttatattaaaaagcattgttgtactttctttttttttccattaaaattgttttctatatttatagtcccattagagaatgttatagatatcaaaattttaaaagtttattatcctaattatattttgtgatttcaataaactttggaacacaaattaattttgtttgggtatacaaactatgaatagaaagataagtgtgagatatttaatgttgtatacaaattagtagggtggttttggtgaatgatttgttattatgcagattattgttaatcctttatattataaagcacaagtcacataaccaatcagtttttgccatattatttgtgtgttttttcaaaagattaattaaaaaaaaaaaaatgcaaccggaaaataactttcacaaaatgcaatctgttttttcaatatttattttgctatgatcctgatttcctaaaattgttcacatgatcacgaccacgttcactgtgaaaccatatttcaaaagctcaaactgtttcgtttttgtaactcacgatagttcaatcttctcttactctttttcttttttatctcacttacatcttttttcttttttgtcaattgtggtctattgcaacgtttacagtgatagtaatggaggagaacgtgcaattagggtttggaggctggtctctacgaatgagcatcttaattcatggcaactctcatggaacgtcaatacaaagggtgaggttgattatttccaagtggtcatgcatcctataaactttgatgaattatttacctgtgaagttggaacaagaacgccctcgtcttgtttaatttgaggacacaaacgtctagtcttcacagagagggaaagaagagcaagtctatggatggttgcatcttgacattcaacaattgtaaagagtacatggatgcgatttaccatgtatgactattctcaccatgtcttcttcacacagttagtgcttccacgctggctgaacaagctccccaagccgaagctttcttcttgattgtgcaagtaaaatctactagataacaaagggaagtttgccacaaagtaggatgtacaatataatccatacactccaaaacatacatataaatccaaatgtatacgcatttgaacaaaagtaaccaaattttcgcatcaaaacaaatcttgtacatttttcaaaacatttatataatccaaaactatcaaactcctaagatgattcaattaaaagataaacctctggcaatgataaaacataaacccaattctatcatactaaagatcaacctctatgcataggaaccaaaaagtcaccaaatttgctcatgactaaatgaaactgacacaaactaacataatcagatccaaaacctatcaaacgcagtcaaagaaaggaatctcggagctgaacttcttgaatgaagatagaacacccaaagttttttctttctcaaatagttgcatatttattttgagtgattctgaatttgatgcacattctactatgcacattctgaattacatagtttatttattgtattggttgttggtttctttaggtgtggtgtacagatggtggagatatgttctatttgtgcagagtggaaacaaaatgaaaagcttcagcggattttcttaatagacacaaacaaaggtgataatggaggaggaaatggtggggatggtggatgtggtaatgggggtaatggagtaggaaatggtggggatgatggaggaggaaatggtgagggtaatgtaggaggaaatgggggaaacggaaatcaggaggctgttgagatacaagatgttggggatttcgggttagacaatgatgatgatggcgatgaggacgatgaagaaaacgaagcagcagcagatgaacaaaagcaagcaattgtagttgaagaaaacaagcagcagcaacggaagtaagcaaagcagcagaggaagtaaccaaagcagtgaatccaagaaagaggaggaggattgatgttcatgtcccaatccactaatctctttggctcaccttcttgatagcttaaagcatagtattctaactctacagcaccacacaattccattacaatgtgtatataattcttatcctcctaagaacctttgatttgtacgatgttaggctgtcctgaaacatgatccatgatttgaatctttgtaaggtttaaggttttaagaagattaaatcgaagagaagccaacttactgtttatttccgaagtatatgaaaccatattacaaaaataagtataacacactttataaggaacacaaataccaaaagaatgacttcttttaagtggatcttacaagaaagtgcattacttgcaacttacaagaagccaaggacaagactagagagtttccaacacataaatgatcaaactaattaatctcactatggttttcaccggtttagctcttcttccctaaaccgttattgtgggttacacttacacacaaaaacaacatcatatgattctattgattggaagaagttccccttctgcctgcttgctgctgccacttctcatcattgcaattcatgttgtcggttatttatgattgaaaaatataaataaatcaataaattaattgataccatattttcaaatattaagtatatcacacttaataaggaaaacaaatacaaaaagaatgacttcttttaagtggatttacaagtgtgttacttgcaactcacgtgaaagtttcaacagatcaaactaaaactttcactttggttttctccggtttaggacttcttccctaaaccgttattcaagaagaagagcacaatatgattcacttgatcggaagaagctccctttgtggctgcaagctgctgccacttctcatcattgtgcggaattcctcaaagtttattttcccatcctgtaacaaagttgttcattacttactatgtttcgaaaaacgggtctaatgtttgatgtattggattggaccaacttacattatcggtatcaacttcggttatgatttgtttgatgctaacttcatctcccacaccatgctctttcattgccatctccaactcttccttggttatgtgcctattgcatttcatatttcagttttaactttatagtagtgataagctaaagtggaagaaacttacccgtcattgtctttgtcaaagtgttggaatgcttggtacacatgatcatctctatccaatctatatctatgcatcgtggcagagataaactcgtctatgtcgattgttccattaccatccacatcagcctgagaagtttataattatgtgttacaaagttatatatttttctttaaagacaagtcggatgcaatgagtaatcaatcaactcacagcttccatgagttgctccacttcggttttagagaggttagatccaagtctagtaagacctgttttgagttcttcaagagtgattgtgccacttttgtcggtatcaatgttggtgaacagtgttttaagacctttgatttcctcttccgatagatttgctgcaataacctgcaaaaaaatcagacgcacacatcattaactgaagataggaagaggtagcaagaatcgggaatggttactctttacctttagagctactttctttagcttgttcatatctcgaaattgcttcaatcgagataaaacaacgccatcaataggcttatctgaagcttctccgtctttcatccaaggatgtcctatatacattacagacataacaagaaacaagacttcaagattaacatacacaagccctcaacaaaacatagtgagcacaattctgaattcttgaagcttctttcttttggaactcacctaaacttaacaatctaatttgattgctttagaatctcaaaaagatagaacagtcataaacgaacttaccaagaacctctgcagcagagattcgttccttggggtttctgttaagcatcctattgacaagatgttttgccttcacatctataaacttccatgattcgctgtcaacgtcgattttggcactctttatctcagagaacatctgtgcctcaggttctacaatatacatacaatagatacgtatatataacaaagcaaaccccaagaagaagaacatttatgttagctttttaagtttgaacctgtcacaaagggaggtttgccgcagagtaggatgtacaatataatccctgcactccaaatgtccgcttctttaccgtattttccctgtaacacttcaggagcaatgtagtaagcactcccagcgaatttccggtgtacttctcctgtttttgttggtttagacaaaaaatacatcaaaacctgattcttgtatgagtcaccaaatccaactctatacgcatttgaaccaaagtaaccaaattttctcaaactaaagagacttgtgcaagaccaatcttatacatacaaaacatttcttatatactcctaagatggattctattaaagatcaacctctaaactcatttttgagtcgcaatctctaggcacaggaaccaaaagtcaccaaatttaaaacacaagacacaaaccaacatactccagtaccaaaaccaatcaaaggcaatcaaagaaaggaatctcgaagctaaccttcttcaatgaaaacagaacacccgaagtcgatagctttgaccgtagcattcttatcggtactggagagcaagaaattctcaggctttagatcacgaagcatcacacccatgtaatgacaattcttgacaacattcacaatcggcctaatgatttcaacagcttctttctcggagtaagactttccatctttggacaaagcttcgatctttttgaataactctccaccaccacaatattccataacaatatgtacagaatctctgtcctcgtaagctttcttgaactcaacaatgttcggttctccagacaaatgcttcatgatacgaatctctctcttcacggcttcttcatcttctctactctttagattcgtcttgagaatggtcttgcaggcgtaagtcttacctgaagtcttctcaacgcattttcgagttataccgaattggccttgacccaattcatccccgaggatgtaaacctttccgatgtcaacgaatggtttctcaagaatggttctttttgattgttttaggttcttactgctgtagcaacccattgagagttttcagagacttttctggtttaaagaagatgaacttcgaggaagtcagattgtcaaaatgtaagatttcagaagatggaggtttatggagaatcatcatctcaattctgaactcgtacatttgtggatttggtctttaagtcaatgttctttaaaatatttaaattcacatagttggtcaaaagcaaacactctggtgcagctagagggtttacaatgatttggtctttaagtcaatggtctttagaatatttaaattcatattatcagtcctaggcgttcggttatccattcggttatcgtttttttcggttctaaagtttagaatccattcggttattttgaaagttaggtttcggtttcggttcttttgctcttaaaaaatagtatccattcggttattttactttgaatattgtcggataattcagttattttcggataataggataatttttggttattttcgaatatttttactattttatatatattctcaagtatttttatttatttagtttagaaataactaatacttttgaaatttatttatatttcggatattttcggttatccaaaatatttcggtttatatccattcggtttcggatatttcggtccggtacattcggttcggtcaaaagaaaaactctgtttcagctagaaaggtttgcaatgatcaagaaatttacaagagaaaaggcctctgttttctccggtttagctttgaatctttgggtttaccaaaaccggaaaaccactatttagtgaaacaattacagagcttaatgatcaatggatacgaagaagtttcccttgtggctgcaaaccgttgttgtctttatcaacaatgctttctgaaaatgttcatctcgttccaatctgtgtctatgcatcgtcgctaatggaagatgagagccattgacactcgctgtagcagagagatggtttattgaataacaagaaacctttctcagttaggttaccttaaacgccaaggcaaattgtgaaagaaaccctaaaacgtagagcgtccgaaatattctattgaattctctgaatatttttgatgtttgtatttctcaattccttaggtcaagtatctataaaactacaacacactttataaggaatcacaaatataccaaaagaatgaattctttttaattggattttacaaccttgacaaacaaaaaatgtggattaaacagatcaaactaaaccatacaaatatgtattattcaataccttaaagcatgcaaatatgtattattcaattgatgatcggaagaagttccccttctggctgcaagctgctctcagttctcatcattgtgcggaattcctcaaagtttatttttccatcctgtaacagagttgttcattacttaacagtgtttcgaaaaaaaccggtctgatgtttcatgtttgatgtattgaccaacttacattatcggtatcagcatcggctatgatttgtttgatgctaccttcatctcccgcaccatcctccttcatcgccatctccaactcttccttcgttatgtgcctattgtattgtcaagcatttcacattttagttcaaaaacattattcgactaataagcaaaaagtggaagaaacatacccgtcgttgtctttgtcaaagtgttggaatgctttgtacacatgttcatctctatccaatttgtatctatgcatcgttgcagaaataaactcgtctatgtcgattgttccattaccatccatatcagcctgagaagttaatcattatgtgttacaaagttatattttttctttaaagacaagtccgatgcaataagtaatcaactcacagcttccatgagttgctccacttcggttttagagaggttagatccaagtctagtaagacctgttttgagttcttcaagagtaatatttccacttttgtcagtatctatgttggtgaacagtgtcttaagacctttgatttcctcttctgatagatttgctgcaataaactgcaaatcagacacacacatcataaatcgatgcttcatagacaaagataggaagatggatcatttcccagggtatgatatgtttccagtgactaggaaaatcacatattagtaagctgtttaagataatacttaggaggtagtagcaagaatagggaatggttcactctttacctttagaactaccttcttaaacttgttcgcatctcgaaatctcttcaaacgggataaaacaacgccatcaataggcttatccgaagcttctccttctttcatccaaggatgtcctatatacaacaaggagcattacagacaaaacaagaacaagatttcaatattcacatagtctaaacaatggaatttcttttgaggaaacaagccctccacaaacatagtgagcacaattctggatccttgaagcttcttttggatccagatatatatatttgtgttggctctagaacaatcttgaaaagagaaagaaaggaacttaccaagaacctctgcagcagagattcgttccttggggtttctatcaagcatcctcttgacaagatgtattgcccttgaatctctaagaggccatggttcctcgctgtagtcgatttccaaactcttaatctcattgaacatctgtccctcaggttctacatacaatagattacatataaataaaaaatcaacccccaagaagaagaagaatccagttagctttttaagtttgaacctttcacaaagggagatttgccacagagtaggatgtataatataatccctgcactccaaatgtccgcttctttaccgtaatttccctgtaacacttcaggagcaatgtagtaatcactcccagctaaatcctggtatacttttcctgtatttgttggtttcagaaaacaatgcatcaaatcaatcatatgaaaccaagaacaaaactaactaaatatggtatacttgaaaacaatctgtaacaacaaaagacaatgtaaaacccgattcttgatacttaacagtcaccaaatccaaatttcaacgcattggtacaaaagtaaacaaattttgctcatgactgaagcaaactaaagagacgtgtgcaagacaaatcttatagattcaaaaatgttacataccaaatccaaaactaccaactactaaggtgattctgtcaaaaaatcaacctttaaactcagttttggtttcatctctaagcattggaacaaaagtcaccaaattttgtccatgactaaagcaaagagttacataacaaatccaaaactaccaaactcctaagatgattctatcaaagatcaacctctttgagtcccaatctctatgcataggaacaaaagtcaccaaattttgttcatgagtcatgactaaagccctatcaaacgcagtcaaagaaaggaatctctcggagctgaccttcttcaatgaacacagaacacccaaagtcaataactttgaccgtagcattgtcatcgttactcgtaagcaagaaattctcaggctttagatcacgatgcatcacacccatgtaatggcaattcttcacaacattcacaatcgacctaatgattccagcagcttctttctccgagtaagacttcccaacatcgtacaaagctaggatcttgtcgtataactctccaccaccacaatattccataacaatatgtacagaatctttgtcctcgtaagcattcttgaactcgacaatgtttggttctccagacaattgcttcataatccgaatctctctcttcacgtcttcttcacattcttcgtcctttagctttgtcttgagaatggttttgcaggcgaatgtcttacctgtagatttctcaacgcactttcgggttagaccgaaattacctctacccaattcctccccgaggatataaatctttgtgatgtcaactaaaggtttctcaagaatggttcttttcgattgttgtagctccttactgctgaagcaacccatctctttgagaataaaaccttaaaagtgtgagatttttggaaatgggtctctttaatctcttttggctgaagcagatttgttatataatctctttagttcgaatttgttttattgttcttccaggcaagtggcaatattaaatttaagattttggtctttaaatattgaaattggtcatttctttatataaattgacttagtcctcgaagacattttacacaattggtagtttttaataggccttgaccttgaaccgaatattcgaaccgaaaaataactgaaccgaattcgaatccgaatttttagaattatttgaataggtcttagaccttattatcctaaaaaatctgaaccaaacccaaaccgaatctaatacatgtgggtatccaaatataaatgtaaacttaaaaatattgattatatatatttttataatactttaaatatccaaaattaaaattataaatccaaatatattagatttttttaataattcatatatattttgatttatttaagataaaagtaaccaatgttataattttctcttagataatttaagtattttgattaaatttagttatatttaggtaaaaagtaacaaacatatttttggataatcggatatttcgggtagatttgagtatatatgaataaaacctccaaatccgatccgaacctaaatatattttgaatatttttgcatttttactaaaataaccgaactaatctgaatcctaactgaaaccaaaccggattttttacaatagttctcaattccctacccagatagattcgatagccgaaaaaaaaagaaccgaacgaatacccaatgcccacgcataacaagttaacaacattaatggtgaatttatgatgaacctatctttgcctggagtcatataaatagtgaattttggtttggtctttaaatattcataatttatattggtcagtttgcttattagacgacttttgtaataaaataccgaattggtttctttaaaattttaaatatatagtattggtctttgggttttttggtcaacgttaatattggttctttaaatattttaacttttgtcgttttcaataattcttacaactttctttattagtataacaacaatataataaaactagtcttactgtaatttttaatttactaaactacattaaataagaatgcttctttcgtgcatctcacgtatattgaacatatccagcttactgacagattaccaaatcataaactcttttgttaaaatattccaaacctgttataaacagataaaatgatacaaagcatgtgacggttttagaccaataatatacgattaatcatctaaatgataaaaatatagcaaaaggatttttactctcttaaggtcttcataaggattaagcaagttctcaagaaaaataccaaaaaaagaagtaaacttgttattgttacaaagaactaagacatgacagaatctcaaactcagtttcagactaactaaggagaaggataaataactctgttcaaacacagagaagatagaagaacaatatgagacagtgtatcaactacgcttacactgttcttccatcctgtaacagagtttattacaaggtttcaagaacctgtttaatgtttgagatgttggctatatgttggagagtgcaacttacattgtcggtatcaacttcggatataacttctttgatgctagcttcatctcccattccatattctttcattgcactttccaactcatctctagttatgtgcctgttgtataaccaacatattaacattggtgcctcaaaatagttacacacatttgaatcttgattctcttgacacaagaaatgatcgatggagcgtgattcgtaaactgcaaatggaagaaacttacccgctgttgtctttatcaaagtgttggaatgctttgtcgatctaatttgtatctatgcattgtcgcagagataaatcgtagtagtcgattgttccattacaatccaggtcagcctgaaaagttatcatcacgtgtttcaagctttgtctttttcaaaaccttaactgtggaaagtgaagccaagatgctgaagataacttaacttcagtttcagagagtctagacccaagtctagttagcccagttttgagttcttcaagattcatatagagccgttttaactccacaaagatagtgagcacaaatctggatttttgaagcttctattggaactcacctaaattccacccaagttttatggagaatcatcatctcaatttctcaactctcaaggtctttgtacatttggatttggtctctaactcaatggtcttttaaatattcaaatttatgttttggtcaaaagccagaagatttgcaatgatcaagaaaattacaagaaagacatacaaacaatttcaaagataaactactatcacctctgttttctccggtttagttcgggtttaacaaaaccgattttgggtgaaacaaaaaacagagcttttatatgtggatcccaacaagtttcccttgtggttgcaagatgccatttctcatcatcgtacaaaactcctcatagtctatttttccatcctgtacaaaatttcataaccaagattcagtaccagttaatagttaaacctctaaaaataagggacactaatggaatatatagagggccatttacgttgtttttatcgaattctgaaatcaaatctttggcattagcttcatctcccataccatgctctttcattgctatctccacttcctccttcgttatgtgcctgtcgtataaacaaagccatatcacatttatgttttcaagaatctatctcactgcattttcaagtctttggttcgatcttgacacatttttttaattttttttttgaataccaggaggttctgggccgaaacccgtaatcccccagacccgaaaccacagcatgtaatattagtttcgtcctaatcgtcactcgaaccggcgacctctaagtttcgcctagggtctttacccattgagctaacgacacttggtcttgacacattacttacccgcttccgtctttatcaaagtattggaatgctttgtataaatgttcatctcgttccaaacggtgtctatgcatcgtcgctgagataaactctatgtagtcaattgttccattcccatcaacatcagcctgaacaaaaaagaaaaaagttaccatttttttgtttttgttaagatcaacaaatggaagtaaagagaagtggcttatgatgataacactcactgcttccatgagttgcttaacttcagtctcagagagtttagagccatgtctattcagccccattttgagttcttcataagtgattgacccgcttttgtccatatccatattctcaaacatggttttaagacctttgatctcctcttccgatagaccctccgcaataaccttcaaaccaaacgcacaaatcacaatccaaagttgaggatcataatcttgaagctactattttaccttaagagcaagcttcttaagcttgttcattgctcggaattgcttcatacgtgataagacaacattatcaataggcttatctggagcttcgcttttcatccatggatgttctacaaaccacaaggattttttagttagacacaaccataaactcgcactaacatttcagactgtaacatttaagacttcaagattcacatagtgtcactctaaggcctaaacaatacactagaagcttcatttggtaaacactaacaatcatgttttcaatttaaatgtttcaaaaatcagttagggcttaccaagaacatctgcagcagagattcgttccttcggttttttggtgagcatcttcccgataaggtgcttcgctttaaaagatatcaaaggccatggttggctctcaaaatcaagcctgcattctttaatctcagcatctacaatacaaagagtagacacaattatagattcaattcctcaagaagaacacatctcaaagtatttagctcaaggttttaccagtttgaaatggcggtacgccgctcagtaggatgtataaaataacaccagcactccaaatgtcgatttctttcccatagcttccctctaatacttcaggagcaatgtagtatttacttccaacaactctctcaaaagttttccctgtaaagtttgaaaatatatcgacgaatcaaacttactataaatagtatacttgacaatatgatcaaatcttgaattctaaacaagcttatgttattgagtattgacacgaagataaaaaaaattttggctcaccttctttgatgtaaacagaacacccgaaatcgatagctttaagcatagcattctcatctttactagagaacaagaagttctcaggcttgagatcacgatgaacgacatccaaagaatgacaaatcttcacagcattcacaatagacctaaagattccagcagcatctttctcagagtaatagctatgagacttgaccaaagcatcgatcttgtcgaataactcaccaccaccacacaattccattacaatgtgtatagaattattatcttcgtaggaacctttgatctgtacgatgttaggctgtcctgaaacatgatccatgatttgaatctctgtcttcacagcttctttttcttcttcgctgcttagagttctcttaggtatggatttgcaagcgtaactctttcctgttgaattctctttgcacaagtatgttgttccgaaattacctttgcctagttcgtcaccgaagctatagtgcttcttgatatcttccaatggcttcccaagaatcgtctcttgcttttgatccgagacgatatcagaagctgttaggggtttacttccgcagcaattacccatgaaccttggttagattttttctagggttttaggaagatgaatcgaaccaagattgttaaaatgtagtaggaatatttaaggagctgtggttttgtgatgaacatctctttggctggagtcatataaatggtgaatgtgttgttttgtttttgttttttttccgcccgattttaattagagttcaaacgaagcaaaaatgagaaatgttgtttacataagtgatataaatcggttcaatgcgaatatttcgcgccaaattatccgcttttacatttgcattacgaaaaatgttcttttggtcttttaaattcgtttttggtctttaaatattcaaaatttatgttggtaagtttactaagtcctccaagactttattagacgacttttgtgtataaaaccgaaagtataaaatgtaggaattatgagctggaatttgagttgtatacttgtattaataaaatactgacttggtctttaaatattcaaatttatagtattggtcattggttgtttaacttgtttttgtcaacgttaatattggtccttaaaataatttcattttgtcgtttaatctaattggtgtgtttttcttgcttctttatttattagtactgtaatttattctttaattgacagattgatcttaaaaatgcttctttcgtgcatcccacgtatattgaacatccagatttataattacaaacagataaccaaacaaataaattaaataataaactcttgaaaatatcttaaaatctttataggctaaatgatacaaagcgtgtgacgttcatagactgatactactagctaaaggccctatatctctgagaggcgagaccgacaccaggttagattcatctcttttgggagatggacccacaccaggttaaatacatcttctttggataagagatctctctcaatatacctcgaacccagcacctctacataaaaaatttaacactgggccaacagctcgttggtctccactcgctctttttgtatttgagaataactttttagctcttcctagaaacaaagacaaccaaagtgataaatacgaatcaccaaagaaccaaggaagaaatgtgcgcaacatgaagtcactaagcttgagaaaatcgaatctgacatgaagcagaatgtgtctcaaggagttgaaacatataaaaagattcaatcagtgcttgagcagattattgggagtagaagtcacattggatttagtaacagtgatgcaacagcaaaatgtttttcttttgcgcctgagaacaagctacattattcgagggcaagagtattgataagctaggaggcacgtgtggtagctcaaaaggattcgttgaggctcgtgaataagcaaagagaagcagagaaggcacgtgaaacagagttaaaacagagcaagaagaaacagattgtgtaaccaattgagagttgtatataaatagatagaagagtattgaaaaagttatgcattaatgcatgtatagatgtgtgtgtaacaaacttatcgtttgctagagaagagttaagaaatctcttgaacaaatctccattgttagagttcttgagtttgtatcttggattgagaagtgataagagagattcctaaggaactattactagcaaaagattacacttaaagctcataaggattaagaaagttctcaagaaagtttcaaaaaaatataagtggatatgttactgttacaaggagctaagacatgacagtctctcaaaatcagtttcagactaactaaggagaaggataaataaatctgttcaaacacagagaagatagaacaacattttgagacagtatatcaactatgctcacctcggtttacccccggtttagctcttctactctgggttcaagaatcgctttcggttgataaaccgttgggatttatgccgacttgatcaatggaatggaagcagtttcccctgtggctgcgtgctgccacttctcatcatcgcgcaaaattcttcaaagtttattcttccatcctgtaacatagttcattacaaggtttcaagaaccagtttaatgtttgagatgttggcttatatgttagagagtgcaacttacattgtcggtatcaacttcggatataacttctttgatgctagcttcatctcccattccatattccttcatggcactttccaactcatctctagttatgtgcctgttgtataaccaagccattattaacattggtgcatgataatagttgtacacatctgatacttagtctccatgacacaagaaatgaacaatggagactaattcataaactgaaaatggaaaaacttacccgctgttgtctttatcaaagtgttggaatgctttgtatacatgctcatctcgatctaatttgtatctatgcattgtcgcagagataaactcgtagtagtcgattgttccattaccatcgacgtcagcctgaaacgttatcatcatgtgtttcaagctttttcaaaaccttaacagtggaaagtgaagccaagatgctgaagataacttacggcttccatgagttgcttaacttcagtttccgagagtctagacccaagtctagttagcccagttttgagttcttcataagtgattgtcccgcttttgtcggtatctatattcgcaaacatggttttaagacctttaatctcctcttctgatagactctccgcgataacctgaaaacagaatacacaaattacaaccaaaatttcaggcaccagtagatatgaggcattgcaatatggagcatagagagattgcaagtggataattgaaatgcaaaattagtaataaagaaagataatttcataaaaaatttcagccacttctttacctttagagctagcttcttaagcttgttcattgctcggaattgcttcatgcgggataacacagcgctatcaataggcttgtctggtgcttctccccctttgatccaaggatgttctataaaccataaggatggctacatattagtaaagcattactagttagacgaccataaactcaaagacaagaacaagatcagacttcaacattcactagagtctatttagacctagaggtcctatacaatggactgactatcttgttctggctttgagcctctaaaatatgtaatcacgcattctatacaaacaggagtgggaaaaaaatactggtattcacattgtcttaccaagaacctgtgcagccgtgattcgtctcttcgggtctttggttagcatcttcctaacaagatctttcgcgctttcagatatagaaggccatggctcacttacaaaatcaatttcgccttttatgacctcatcgaatattcctttctcattttctaaaatataacatatgaatatagatcacacctcaagaagaaaacaaatcaatgaatttggttagcttaaaggtcttttaccggcccaaaaaggaggtacaccgctgagtaggatgtataaaatgacacctgcactccaaatgtcgatttcttttccgtaacttcgccttaatacttctggagcaacgtagtaagcactcccaactatatcccggtaaacttttcctgcatttgttggtttcacagacatatcatgaagcatattaacataagaatcaaactaatgaaaattacatacttgacaatatcataaagatgtgtacaaaagacaagataaactcgattctcggtactaaagtgtcttgagtctcatccctatgcattggaacataagacaacaatctagctcatgatcaacggaaaaaaaaagtgcagatcttaaataccaaagaatatgatcaatcttcaatgaacagagaaaacacaaaatcaattgttttgaccatgacactctcactgttactcgaaaacaagaagtactcaagctagagatcacaatgcaatgaactaccaaactcttaatctttgacactaaagagactagacaagcttatagattccaaacactaacaatccaaaaccaaagaccaaaaaaggctatattgagtctctagctaaccttcttcgatgaagacggacaaaccgaaatcagtagctttaagcatagcattctcctctttactcgaaagcaagaaattctcaggcttgagatctcgatgaaccacacccataaaatgacaaatctgaacaacattgacaatagacctaatgataccagcagcagctctctcagagtaatgaccttgagctataatcctatcaaacaactcaccaccagcacacaactccataaccaaatgtatagattgtctatcttcataagcacctttgatctcaacaatgttaggttgtccagacaaatactgcattatctgaatctctctcttcacatcttctttatcttgcttactaattagcttcctcttaagaatcgatttgcaagcataagtgttaccagtaccaatctctttacacatatacgtaatcccaaattgacctcgacctaattctttccccaagctgtaaaatttcctgatgtcttcgaatggtttacctaaaatcgtatctggatctcgaactgagactggatttgaagacggtgttgaaatctgctgatggattggttgagtcatgggttttggtgttggggtttgaggtttacgatgctcggggactacatgggtttgaactggattgatcgggattgatttttctccgccgtcgttttgagttttccggtgtttactgctgaagcaacccattagtaaaggaggagactttcgttattgggtagaagaaaaagatgagcttgaaggatgattggaagagagaaaccaaaatcggaagaataattgagttgtgaaggttttgtttgactggaattggaattatctatcagtcgcgtcaatttctgagtgtaatagatagaactgtttaagtaaattgtcttttgtctttgtcaatttgctgaaaataaaatatccacaataaattaattatatttaaaataaattaaatttgacttacatttttcaaaggaattttatggtaaaaaaatttcgaatatttgttctggaacggaaaaattccttgttttattggacgggtacagaatattccatttataattagaaaagtattgaatttcgaactgtcaagtgtcaatattatttttaatttcaaaaaaaaaatagtgtcaatattactttgatatatttttccattacagctgatataaaaaaaaggttaatgataaaaaataaccataaaattaaacaaaattaaaaaaataattttttgtcagaaaatttagataaataacattttttaaagtagaataaatactaaaaaatatctttctattttcttgtttctacaataatgccagtgataataaatcagagttgattaacatctgaataaaaaacatgaattatttacagacaacatagtatctaaatgaattaatattttattaaaacaatacatgacaattataaaaggaacatgcattattcagaagaaatacatcttattgttcggataggtatgaataatattacagtagagaacatgaaatatttaaaaggtgtagatcttttatataataccatgtatttttagaaaatgcatgtctaatataaaatgaacatgcattattcaaaagaaacatatcttattgtttggatgggtaggaataagatacgtgattacaatagaggacatgaattatttaaaaagtgcagatcatgtcaaataaatacactgcttttagacaaaatacatgcctaatataaaagtaacatgatatatgaaatgataacataacattgaaagaaaatcttaaacttttgagggtgaaagcaaatctcagattctaaaaagaaacgatatcggaaataggtaaatcctatatagaccaaataaatggaagagctcaatggttgaaccaccaaattgatgaaaaccaacaccgtgaacggctatagtcaaatgatttactagagcttgtggtggttattgtgatggagatggttatggagaaggtgatgatggtttcggagaaataaaaaattaatgtacggtttggtttagttagggtaaaagtgtcataaatgaggtgtaaaagttattttctctctcatactttttatctatggttattctctttattcttttgttgtcaaaggttagttagtatatatactctaaaaaaatagtatcgatctctttaattcgccgctacgaaggctttgattgggccttgtataatattgaattttcctttgcgatgatgactagaagttgttgattactcatgagagaaagataagtttgttttttcttgggataatgagagctatttacaatgttatttaaagccatgaaaaaacaaatttaaataaaagatatgatttgaacttaattttgttgtgttgccacttcttaagtttgataagctagtaagtgtgataagctagtgagtttgataaactagtaaactctaaatatattatgagtttgataagctagtatgctctatatatatatatatagttgtgcaaaaacttattataagtttgataaactagtaaatatatatatgtgagttgtgcaaaaacttactataagtttgaataagatagtaagctccatatctactatgtgtttgataagctagtaagcaccatatatatattttgtgtttcatatgatttattgcataatcaattgttcatttagtaaacttactattatgcatagtaatttactaaaggaaaaaagattgctagctacacgaagtataagagaatacatggtcacacataccaactatactattgtatatccagctacacgaaatagatgtattccataaccacgtatatgaagtataggacgtcatgtagttaacaccataaacatacaattccggtaaaccggtcagttgactccggcactgactagtgttgaccggcgttgaccaaaaaaaaattcaaaaagaaaattaaaattatttttaatattcaaaaatacgaaaatatttttttgcttttatatattccaaaacatattatatatttcgtaaaaatatatttgtattttcaatgcattaaatcttataataattagttttatttttaatttcaaaactaaaataaaactagaataaaaatcattattaaactttagactaaagagtcatatactcgatttcattaggaagcaatatgaaattgagtatatgactctttactctaaagtttgcatggtaaagaaaattataattttattttacatattctttagtctaaatttatttttgtatactatttagttcccttttgtaacaaatattattaagaaaagttctcgtaataacacataaacaaccaaaaacttgcaatttttctttttaatatataaaaagatagaaaatctaacaatgttgatttcagcaaaaaagtttgtaaaataaaattcatgtgtattatgttttattctaataatttttgtggttgaaaaatatttttttaaaaaattgtatagaaataattgaagtgttttaattgtcaatataaaaataagcaatttccttacttaattaactctaataatattttcctattttaatttaaattttaaaatttaataatgatttttattctatttttagtttagttttttttttattttaaactaatgaatatagaatatgtttttgaatatacaaaaccaataaaaattatttttcgtatttttgaatatttaaaataattttaaagattttttaattttttttgttggtcaacgacggtcaacactagtcaacgccggagtcaactgaccggtttatcagaattgtatgtctatggtgttaaccatatgacgtcttatacttcatatatgtggttatgaaatacatttacttcgtgtagctgggtatacaatattatagttggcatgtgtgaccatgtattctcctatacttcgtgtagataacaatcttttttcctttactaaatgcacgataatcaaactcactatcaattgtaataatttattgaggattgtggaaattcagttggatacttaacagtttatttcatagtcttttaagtgttttaatcatagataaaagaaagtatgtggacatgtagtcgatttatttgggctaggttaaatcactttatctatgtgcaatatttgatgatatttgactttttggatcagcagaatggctggtcaacaacaacattttttgttggtctcgtgtagattatatgtttctagatggaaccatttgatcaatctagtcaatacgtggtcgttgaacgcggcacatcataatgaaggacatgttatccaagatattcgcgtgtggttgcctggagtagtgcatactattttctttgacatggatgggaatattattggtgataatgttggtgtgcaaaatgagggtatttttgttatttagatttggtttattttttagtttaattatagacaaagtttaattacaaaaatatttatataattttaatgtatccttaatatgttaacttaacgaaaataatttattatgtactcaccaaatcaaattcaactgtgtttgggttgatgaagtaaaagaagatttatcgaaaataatgccacattcaagtattatttgatacacttctagtaattttttttttttctcataagtgttgtcattcattgaaactaaagtatgtcaaagtacatgtgtggaaacatccacttacaatcttcagacaacaacatgtgaaacttaaaacataacagaacttttaaactgcagactaacaactatggataaaccaaagttaacacagaggtatccatgttgcagaacaaaagctgaaataaaagctgaaactaaaacaacataccaaagcagatatgtcatttcgaactccaaaaagtgatacagagaccatatatgagttgttattcaaacctgaaactgaggctgccaacatgaaatcatggcaaccttaaaccaaaaaatgtgacaaaatgagcagagttcttaacgtttcttaggaggtttgagaatacctcccattctttgctcagtttcttgttgtttgtgttgtcttgattccttatctcgctgaagaatgatcaagttcttcctcttagatgactccccaagatgcatgttattgtgagattccccatcttgagcacctcttgatgattttcccacctcaaaaacttgccttactccataagtaatcgcagctccagaggcttgactgatgttagagtcagggaaaacctgatgacgtctaacaccagcttgagtagtcggaactgtgaaagcttggaaagctgaaggtcttgaagttggaaagtatggagtaactgctgccaattcttgtggattcaatggaggtgtaggcactcgtggaggtggatgtaaaggaaccggaagagagctatcagtcatttgagattgagagttaaagcttaatctcaaaacactatccctgaaagcagctctttccctgtcaatgctctgaaaccgttggcggtaaggacagtagtttcggttatgggcctgagtctctcatattgatgtataaatatgtaaattagtaaatttgtttgatgtataaataatcttctaataatgcacacatattaaaaatcatttaaaaaataattttcacacacagattaagaaatcatttaatttttttttatttgtaaagtaaaacatcatttattatctattcaaatatgattcaaccaataaaaaataatctgccgaatataaatcgccaaaactaataaaaaaactaattaatccctaatttatattaaaaattaaaaatatcatctaattttgaacaaatttcctcttaaaacatgaaatggaaggttaacgtcatttatactaaaggtttatgactaacgttagtatagagagccaggtttgtcaaatgacgtcttataagctgacttaatatcagaatttatgaaagtaacgtcggtttaaaagcaacacaaaatttttatagaccatttctactaaatttttatataatttgtttttatcaaatctaaataaaatttgctgtcaacaaaagaaatcttttacctaaattagaaagacaatcgaccgaaatgatgatatttatattgtttgaatatactaattttacataaagcataactttgtccttgatatgtggaactgttgtattcaaagccacttcacgaagtctttataagctgacttgctcgaagtcccagtttccctgaaagaaaaaagaaaaaaaaggagcaaaaacgctttaagagaaacattatactcaagattttcaagtgaaagcacaactatttaaaattacaattacgaaagggagaagatccaagtaggaaaaagcagattacagattcataagtgagctagtgaaatgattcccactatagctcaatgaccaatcctactggtgtcatatccaaaacacataagcaatattcagaactgttatctttacatgtatggtaaacttgactacaacaaacaataacatacatgatctaagtgaaatttggtccagttcataacatctcactagcaaatttcgtatcaactattgtagctacaacacaatgggttgcttttaataatattttttttcccgaaggaagaagactcggaagctagacaaagagaatatggattttaacaagttttacctgatctatcacaagtgcagaaagatccatcatgacttgagcaagatcgtttactgattcaagaacgtagacaaagtgtaagcacttgcctaatgcaactctctgactctacccgtaattcctctgctcattttttttatcttggtcatctggtgctcgtcaaactgaaaagaagatttcaggtatagattgcatcaataaagtacatatgaggaatgatggctataaactgaaagaataaaacacatatagaagttggacaatatcgccaaagtcatcttcttcaggtctacatctgtttctcagatcctcagaatctcagatttatctctatattcatcccatcaggatagtacattagagtcgtaataaagtttttgatgctcaaagggttcctaaggatgttgagaaaatgtagatgcaagataaagttattactaagttaacaactactcaaattcaaattcctttgacttttcagatcatttctgtatattttgagtatttgacaaacgcaggaaaaaggcaaatcagaagcatataacataaagtgcatcaaatcaataagattctcttaagagattggagaatagtacaaagaatgcataccttgagggatttaataccatgcaagctgcacaatggaaagcaccaaaaatgtaaagccagtcataggtgtcctagtttcttctacaatgtatccctaaacaactcaataggcaattgactaacgatttggagtcaatagaacatggaataatgcaacaacatttcaaatcaatctcttttacctgaatctccttaaaattcgcaaagagattgaaatctcttacctagaaaactttcatgaatccatcatcctaaaaccaaatcaagaatccttgttagactattcaatcgaaaaacacacaaatatgttatattctaccattcaatcttatcgatttcgaccaatggaaaagagaaactctcgacagaattagcaaaccacatgatcggattgagatgtttttttacctcattccagaagatcgatttcatagaaatcagatgcgaaattcacaaaaagcttcggataaagtattcatctatcatcttatatgcaatctccataaagtatccagcgtgacttgagatctatctcaaattaattgctgcacagaacgcacccgtaagtgccaagacccatcaattgttatcttccaacgagtctcttggtgagtctaggtttctgtaaatctctggaagaagattataaacggcaatctttatcatcaagccgcattgttaagcactggaagatataaaccatcttcctgaacattgttttgcttgaatgtgttcactggaactcctatttctgcaaggccaaagatgaacaacggctggatttctctaatctctaaaacacttatctcccctttctaagcagtgtgatcacaaagtctcatgattgctatctgtctcgacatattatcaattttacctaacgcaacctctctcatgatttccactggagataaagcctaaaaatgtccaccaattctcagtcatcatctactccaagatattgactttcattgcgagaaggactgaattcgaaggctgtattgtgcacatacttgtccagttttgtaaccattcgatatatctcccattgatatatctcgaactgagattgggtttgtagacggtgttgaaaatctgttgatggcttggttgattcatcttttgccaccgtcgttttgagttttccatgtttaagaattactttccgttggatctatgtagtcttggtcagtggaatggatactgtttcccttttggttgtgtggtgccacatctcatcatcgcacgaaattcctcaaagtttatttttccatcctgtaacatagttcctttcaaggtttcattacaagcaccggtttactgtttgagatgttggattatgttagagagtgcgacttacattgtcggtgtcaacttcggatataacttctttgatgctagcttcatctcccattccatattccttcatggcactttccaactcatccctagttatgtgcctattggattaccaaatagcattaacattggtgcctcataatagttacacacatttgaatcttaatcctcttgacaaaaaaaaagaaatgattgattcgtacactgaaaatgtaagaaacttacccatttttgtctttatctaagtgttggaatgctttgtgtacgtgctcatcgtgatgtaatttgtatctatgcattgtcgcagagataaactcatagtagtcaattgttccattaccatccacatcagactgaaaagttatcatcatgtgtttcaaactgtctttttcaagatcttaattgcggaaaagagaaagcaagatgctgaagataacttaccgcttcaacgagttgctgaacttcagtttcagagagtctagatctaagtctacttagcccagtttggagttgttcataagtgattgtcccgcttctattggtatccatattcgcaaacaaggttttaagacctttgatctcttcttcggatagactcaccgcgctaacctgcaaacagaacacacaaattagatccccaagttccggcactagtagatatgagatgtttcaactgattagagaacacaaagagatggaaagactataagcgagatgcataattagtaataaagaaagatttaatttcataatattttgagctacgtgattacctttagggctagcttcttaagcttgttcattgctcggaattgcttcatacgtgataacacagtgctatcaataggcttttccggtgcttctccccctttgatccaaggatgttctataaaccataaggattgctacatattagtaaagcattactcggtaaacgaccataaactcaagactggtattcacattctcttaccaagaacttgtgcagcagtgattcgtctcttagggtcttcggttagcatcttctcaacaagatctttcgcgctgtcagatatagaaggccatggctcacgtacaaaatcaattttgcattttagaatttcaacgaatactccttcttcattgtctacaaaataacatatgattacagatcaaaccttaagaagaagaagaaaaaatcaagaagttttgttagcttaaaggtcttttaccggcccaaaaaggaggtacaccgcagagtaggatgtataaaataacacctgcactccaaatgtcgatttcttttccgtaactctgccttaatacttcaggagcaacgtagtaaggactcccaaccacatccttgtaaatttttcctgtaattttggtttcacaaacagataaacataaaaatcaaaataaactaaaacgaaaacataaacatagttaaatctgtacaataataagacaacataaacctgattctattactaaagagtagagtcccatctctatgcattggaacataagtcaccaatctagctcatgattaaagcacaaagtgcatattttcgattcgtgaaagaatatgatcaatcttcaatgaacagagaaaccccaaaatcaattgctttgagcataacagtctcatcgttactcgaaaacaagtacttgatactaaaagagatttgtgctagacaatcctataggacccaaaacctatcaaacgcaatcatcaatacactaagaatatgatcaatctcgagctcactttattcaatgaacacagaacatttctgataagcacataaccagagtaaaccggtgtcatagaaaagagatgtggtcttgttatggctcctaaattaatgggattgtattctccactccccacgatgttagtagtagatttagtggttattttctttcttatttttgtgtatttaaagacttcaatgtcaagttaaggaatcagacttgaaaattgacaaaacagagtttatctctttggtactttgtgtgttcttgtgttaagacaaaacacatctctttggctttgaggagggaccacctatcaatttcaaatcggactcctttatgcataacattctattcttattctagagtatatgacatcacgattcagtgaactcctaagatgaatgtagatactaaagagacttgtgcaagacaatctatagattcgtaccattagcataccaaatcaacctaagatgattctataaaagatcaatctctatagctaaccttcttcgatgaacgcggacaacccgaaatcggttactttaagcattgcattctcctccttactcgagaacaagaaattctcaggcttgagatctcgatgaatcacaccattcaaatgacaaatctgaacaacatccacaattgacttaatggtaccagcagcagctctctcagagtaatgaccttgagctataatcctatcaaacaactctccaccggcacataattccattaccaaatgtacagaatgtctgtcttcataagaacctttgatctcaacaacgtttggttgtccagacaaatgctgcatgatctgaatctctgtcttcacatcttctctacccagctcactaattagcttcctcttgagaatcgatttgcaagcataaatgttcccagtcccaatctctttgcacatatacgtaatccctaaaccacctcgacctaattctctccccaagctgtaaaatttcctgatgtcttcgaatggtttacctaaaatcgtctctggatctcgaactgagatgggtatcgatggtgatgggatttgaggtttacgatgatcggggacttgatcaacgatatgggtttgaactggaattatcggaattgatctttctccgccgccgtcgttttgagttttccggtgtttactgctgaaacaacccattagtaaaggaggagacttttcgtagactttcttcttggattgaagaagaagataaacttggaggaatttgattgagaacacatttgtggtttgtattattgtatatgtttgactcgaactgtaagaaatttttgaaagatttgaattttgagctggattttggacttttttttcatataccggaaaaaatatatcgagatctcagattgggctgctctggaggccttaattgggccttagaattattgatgtcataagagaaagataactcttttatatttcttacaaagagatcagtttataatctttattctttagattggttggttaaaaattatgttgaagacaaaaagaaaataagaaaataagttaggcaaaatgtcaatggtccaatattagtttcagaaaaataattaaacttaaaacaagttaggcaaaatgccaatgatccaatataaaattactaaaatagactaattaatatttggtaataataaaaaagaatataaaattaaaacagaaaaactcatgaattaatatctgataactaacagttttaaagataacagttttattttaaatattaaaacaaaattgtccaagaacaaaaaagataaaggaaaaacaatctatgaaagattgatcttttttataacgtgaaaaatattaagtgatagactttaaaatattaaatttcgaatattgtttttaatttataaagaatgtggcttttcttttaaatttggacaaaattgtcatttacatattaaattttttaatctttattaaaagtagagaaatgtatatttttcaaataaaaacttaaaaataaggtaattttcaaaatctaaaaaaaaaacacaataactcttctttcataccatgcacatgcaccgcactgaatcattactcttacgtaaccatcaacgacgccgtgaagttatatgtttacttcccgtctgggaattgtcaaaactcagttgtatactaaacgggttattgtttcagtcatgacaattagattgtggacttgtgtttgtttcagttaaatcaatttatctccgtgttttatatgctgatttttgactttttggttcagtagaatggctgattaagaacaagaacagttcttgattgtcttgtgccgcctatcagcatctagatggaaccatctgattagtttagcaaatgcttggtcagtgaacacgggacatcataacaaaggagcagttgtgcaagatgttcgcatgtggttgcctggttatgtttgtttttttatatggatggcaacatcaatggaggtggtgggggaacggaggtggtgggaatcataatttaattgaggtgcagaaccaggattttgttgaggtttcacatgacgttgttgaagaggaagcccataggaagaggaagacgttgaggtagaagtggttgtagttgaagttgaagtcgccgtagttgaagttgaggcagaagtggctgtagttgaagttgagccagaaaattcacgttagagaaagagggttggtgctaactaatggataccatacaaacggcaacgtcttttgtgagtttaggcggtcttctgtacaaaagattagatcatcctcaatggtaggatattaatcatatttaatgaataaattttgaaattttgttgttaagagttttagtaagtttttaattttttagcaacctcaatagtagtatattaagttggagttttttaaaaaattaatttttaaatttttaaatttttttgaacttaaatttgatcaatagatgacataataattttttaaacatacatgtaaacataaagtttaactattgatttctcgtcgatttggtcgtggacaaccagagtcggttgagatgagagctaacatcgggaggacgcccgggtctaataaacacaggaccggagaacgcgagacggccatatcgattttaaggagatcttctgcttcctaccttcaatcgcgaggaaagagagaaagaggggagaaaaataattaaacgcaaaaaaatgtttttttgtttaatatttttcttccaaccaaccaaattattccatgtcaccaccgcattttgcttaagagcatctcttagcttaaaccacctctaaactgaattgatcaattaacatataaatttaatgatttataaacctaaaaactccctaatatcctccctttaatgatgctcttagacaaggttttatttgactagaactgcaattggaattttcagtttcatcaatttctactgtcttttgtcaattgaatatgatggaattggaaatttcgaaaagttgtgaattctgagcattttggattttttaaaatatcagaaaaatataatttgaggtctgagattgggctgctctcgaggctttaattgggccttacatgattgatgagagaaagataaatcttttatttgttttgtacaaaaagatcagtttataatttttagattgtttggttaaaaattatgttgaagacaaaaaaaaagaaaataaattttttggttaaaacaaaatttggtttatttcgaatttcggattttagatttactagattagaaatattaagtttttctttcgatacggcttgaaacttttacttcgattatagacaaaatttacttaaaataatgaatttaagttaatagttttaatgtatctttaatatgttaaattcaaaaaaaaagtcattaacttatgaacacacgaaatcgaatttagtagggttttggtttactctgtacaataatatataccgtttggaataatgtgacattcaggtcgattcaaatatttgacccacttctgataattttgtttgatgtgtcgcaagccaaattcaagtttggcaaaaatgcgtaagtgaactattagactataaaaatactaaaatagtacgtgtaaactaatgcacattttaatctatttaatcatagtcatcataaactatgacatgataaaaacaaagaaagaaattagaggtcaacattctacccaaacataatcgtaagtcaacgggaaagagctaatggctttgaaatatgatcaaaattaaagaaccgacaagatcgtgattgatgaatgagttatgtggccatgttcggtctttacagctttttccagtttctcttcacacacatccattttccatttattacattgaatttatattattacattgagttataatatataaatcgtatatatatttccaaaatattagtaacaaaaagtcgtaacgcattacaactatttttcctcgtcatgctttaggggttgagaatattatgagttttttgctttggaagaaaacaaaatttaggtaaacattgttgttttataatgtcttcgaccattagtggccagtacattatatggcaagctacaacttccaaaacgtatagaatttttcaaacaggcttcgacatctacctgctatatatacttagaatatgtcatgtataaagccgaatatgctatatgcatggtgatatattacttgttagaggcgtagagcatattcgttcattcacagttaaactgctttttcacaactattaaatgttaatatgtcatagtgcatatcgaagaaaatgttttctatgcaagtatatacatgtgcaacaaaaacaatatatttggtctctttggtacgactcgttgcaactgaggaagagtacgagccgatatgtttgacgaaattttgcttagtcagtgtaacaaaaaaaaaacagatttatgttttgttcttttgcttttagaaattagaactggtatttcatcaaatattataatccattttgacatagtttaatattatctatgtagctgttcacttaaaatagtcattttaatataatttaaacatcacataattttttgataaaacatatttttctaactttctcatcagctttaacctaatcccaagcctaattaaacaagccatatgcaggttttttgtgagccatgttttcacaaaatcaattaattctcaatatacatcgacaaatcaatcttatgatcttttccatgttcaaagttttagccggagctcccaaattaaccgaactttcctttttttttttttttttttgaataccaggaagttctgggccgaaactcgtaatccctcaggcccgaaactacatcatgtaatattagttttgtcacaaacgtcaatcgaaccggcgacctctaagcttcgcttagggtcttataccaattgagctaacgacacttggtattttaaccgaactttcgacatacacaaataattatatttgtttcacaaaatttaagtatattataaaatataagacaaaaacaaaatcaagttcatcaaacttgaagagagaagagaggaggaagatcagagatagttcgagaagaagaagatgaagaagaagaacacaagaaacgtttaaaagatttgaggaaacgagtgataagattattgcatatacaagtgttggtcttcctcagcttcctgagcttcttaccaattctcattcttatcccaaccactctgatcataatcaacggtccagatgatctcctcctctgttgatgctgtctggtcttgctatcggctcgttctaaaaccttttgaattagaaattgagctcgtctgtgaattagctcttgagggtcttctttctccatctttgtgtactcgtatggactattcttcaccattaatgccattgattctatcttctttttttgagttcttattctatatattgtagtatgaagaaagattgagtaagctaataacatgaagcagaagtatatatatagtgaaagatgggcagagaaagagagacaccatgtgaggattattaattaggtatatgaataatattaatgtgtgtacatacatgtggattaatgataaaattattttccagttggtttgccaagactatattatcttacacacgaagagtgtgatcggtagtttttagagtgaatatacttggacaaaaattgagatattggcttgaaaaaaacatccacaagggtaaaaatgtttattttactattttagattgaaaaatttatagtttatttattacaaatatttcaacatattggaattaagatgatgatttataacgtttacaacaaacatatctattttttatgaatggaagattcaatttgcaacatatatgaataatcatgataacctttcaacttgcagaagagtttctgaattaaaatatataatatatatattctcaataaaaaatctctaaaatatcaattgactctatttccaataaatagaaggagagagaaaagaaatatatttttaatttttttgttttatcttgattagtataacttgaaccaaagttgaagtaattagtttttagtttctttttctattctaaaagcatattcaatgtttatctctatttttttctttattttagatattattttatttgagaggcactttgttccaaaaaatagactaatctctatttatgttttctattttagagaaatacattagagtaaaatcaactcaatttcctctaaaataaaagaaaaattaaggtgtgcattagagatggtctaaatttctaattatgttaaacaataagaccattaatttgatatgttttatcaagattaaaacatatttagaggcggccatcacatgaaagacttaaatttagctttgacttcaaatgattatataatcatcattattgaccctttaatttgatattagttaattttatgtcaagtttgctttgttttttggcctttaacttttggtggtatttatgtggcaatacttgcatgcatgagctctttttctaaagtatccgatgatggacgcaacatgataaagaatctcttacgtaatagtagtacgagtaatttattaatcatgtattgattgtttaatcgtcttcaacgttcgataatgattaactagtcaaccatgtatatttccaaacatttaccattgtaaaaacttatttatactactctttctgtttctttttctgataaattttaaattaccctttacttcttcaaatcgtatgcatgttttgagattttagatttccacacattttaagaaatcaattgcaataccaaatcaaatctagtaacacatgtgttatgcataaaaacatgaacattatagaaaactgaaaatattggtcactactaaccaagtgaatttctagttattttgggaaaaaaaaactcaagtcttatgaaatagagagaaatgatccatgtttacattaatcataagctctgaagaaataagttcgaaatcctaccgtggttgatatttttttgtaagttaatgagaatttttttggttgcgaggaagctgtaagctgtacgtctaaggttttgaggcttgacttggattgtaaagctcgtggcaactaagtgaccaaatcttactcgaataagctttttgacgatcgacgcttgtttaagatgatatctcctcgttatttcctagtcgattgatgcttgtttgttacttttgttatgttgttgtgtttgtttgtctaatttcgtagatctttttagtattttctgctacaactgaatcattgtaacttctatcaaaatttgaaaatggtttaaatttaatcttttaccaaaaagtaaaataataataagtttgaaatgtttcctttttgtaaattaattgtttttgattaattcaaaaaaagacttttaaaatataagaaattttttcatccaaatagatagaaataacatattagttatctcatatcatatatttctctcaaatgttcatcgtattcatttgtagtgacaaccatttgcatcctataaaccccaaaaaataaatcattcgtcaggcccaatcatgtcaaaattaaaatacttgaaaaatacacaatcctatatcatagctgacgcatttatttcatacggcatgccggcaaaaacgtcaacagaaattaaataaaaagaaaagacaaaatttccaccggcaataagctttgaaaattatttcatatagtactaataataataaccaaaaataatgctgatatgaatgaaaaaacaaagaaacggtgtcataatgatgggacaagcagagttgagatctgtgtgagtgagtgattacctgaaaagtcaactcaccggcttaagaactcggcttttgccagctctctctttttaagccttctttaatcaatcatgaaacgatcctcttgtgtagttgcaataagttgctatttttctattgaattttgtattacaaaactaattcaacaattatttacaactaatttcctcaaaagagctattattcagaccagtttgtatatagtgtcaatagaaataagtgtggagttctttacagaatccaattaaatcctgaactattttaaaaattgtctctaaaaaatgacttgacatactaacaacaaaaagtattttaaggtagagattcaaattcgtcaaaagtaaccaccgatgggagatttaattgggactctagtcactgaaagtcgaatctggagatcaagacggcgaagaaattggtttcaagaggttagggtttgattaagagagaattgctaaaaaagaagaaataggttagttttttttgtagtttctcaaacataataagagtacttttgtcatttaccagatataacgcgtttgacgctgactttcattagcatctacaattgttagccgcaggatgctgagtttgctgcagctacttgcgtcaaccaaacgaacatacatactcagttacgtttgccaccgccacaacaacatgtgatgaccaaacgaacacgctaattatacacgacaaggatcctcttattcttcttgcgagtcatgatcccttttacaaatttataaaccttgtgatattatcttcactaatataaaacttcatatgggttgcacaagtttgcaaatatttctagctttcgaccaaaagcccaaaataatctacccctctgccaaacaaagtcttccaaaattttcttatttgcttcccattagaccatttgtagctatatgcattaggttcttttgaaagagaaagaaaaataagagaactgcatcatgttagtcttgatatctattcaattatcgtaccctaaatttaaaatatttcttaccaaaaaataaaaattttggaacgaaaagcgagaaaaaactcggcttttacgaaaaacaaatatctgatgacaaaaaaacaacaaaatacaaatatctttcaaattggtaagcaaactctttaacaattactaatccgagttagtttgttttcatatgtcatatcaacaaaatccatcctacatacctcagatttttagaaaaccgaatccggatttttgtagtctacaacttaaagacactattgaatctacaccatataagtatagtgaactgtaacattaataaacatgttcacctaaaaaagaaaagaaaagaaaagaaagtaaattatcaacaataatgaatacttgttttcttaaacgggcctaagtaacaagaaaagcccaatacgtgaaacataagtatattcactaggctataagcccataaaacatatgttgaatagactcacgagtcacaagtccccaagtctcaacagacggtggatgatgctccgagtctgactccggagaagaaaaagtatatgtgtgggattggtagttgccacgtgagtacgtgaccctgcgtggtagttggctattgattagtatttgttttgatgtccccagtccccacttttgttactgagctcgacgttttctttcttagtaaataattgattccaacctaaagcgttgtctaagatgactttagtttttataatattgtcgaaaacgaaaatatgttttttataaaatgcatgtttgttactagcatagctcatatacattatggtccgcagtaaaacaagattctgtttactctacttgaatttcaaccatttctcatgttgaaagttacttacttgaacttggacattgaacatatatagatgaatatccaaaacttaacacaccaatgattttagaatttcatgtgtctctcttattgcattatttaagaaaatttgccacttatgatatgaactaacaccagtactaattccccaaacatatttattaaccaattattttcacgcatttatttgaagattcgaattatgatttttgtcttttcttttgagtaagtttttttttttttttttgaacaaagagtaagtaatacttaaaaacaattccatgtccataaaattttactttatcaaaaaagaatactattaccataaaagaggtaacacaatctgtgttttaagttccactacttcaggagaccaacaatcttccaaactcaaatacaaaaaggtttgagactttttccaagatttgtctcttctttctttattctacctctaaaacaaaaatcctaatcgagttctctataatattcaataaagattataattcttcttttatcttttgataaaacttgtgctttcatgtgattgtgtttcactttgatttataatctcagattccaaaaatggcggaagaatctttattaccatctcatacagaagatgtatcagcttctcctaataaatcttcatcacttctgtctgaaatatcaaatgcttccacgagaccttttgttcttgctttcactgttggttcttgtggtgccttgagctttggatgcattgtgagttcctaagttccatttttttgtaatccttcaatgttattttaacttttcagatcaacatcaaaattaggttcaattttcatcaaccaaataatatttttcatgtatatataggttggatatacagctcctacacagtccagtatcatgaaagacttgaatctatccatagctgatgcaagttcaattattatttgagctctttcggtctattccggttctttgtttccggttcgatcggttttgttcttggttcaactaatttttcaattattgttcttttttttgtctttttcagttttcattttttggatcgatattgacagtggggctaatccttggagcattaatttgtgggaaattggcagatttggttggtcgtgtctatgtaagtttttccactttaagaaaattactagcactaaatttacgaattttaactatacaattatggatgtaaccaccattttaaattaatcttgaaccagacgatatggattacaaacattcttgttttaatcggctggttagctattgcatttgccaaggtttgcgagtttcttattttatgttatgtttccataatgaaatgttgattaactcgaaaagtgaatataattctttaaatatcttcttattctttttttctgtatttttttgttttgttacaaaggatgttcggctactcgatcttggaaggttattgcaagggatctcggtcggaattagctcatatttggtatgaaaaatgattataaaatataaatagaggtctttaatcaagagaaatgccttgaatgtaggttgaggattaatatttctaaaatttagtttaataaggttatacacatcatttaagaccttatcctaaacttaaaggaaccatatatacttcaactaagttgtgttatttttggaaatctaagatttttatggtaatttggaacacaaagcacaaaatgtgtaataatttaatcctttcagtcaaagaaaaaaaaattcttttaataaatttttcgtttatattctctgatattttgattcaatggtgcgtatacattcaacatatttgatagatttgggctttaactcagcttctaactcgaaaccaattggcaatgaatagagtgaccctaaccttttatatatcactagatatttcctctaacttcggatgtgagactttctctcattaacagtattaatttacttgtaaatgtacttttttagtttcagatcgatgtgataatttggtaaattcaatgtgttctataaactttgagatttgaatttattgaaaatgaaatttcatattagattctggtattgattaatcacagggacctatttacattagcgagttagcaccaagaaatttgcgaggagctgcttcttcgttgatgcaggtaaactaagagaagcagaatccttgaaaactattacaaaaatataacataattacataactataagttttaaatgttctacagttatttgtcggtgtgggtctatcggccttttatgctctcggaacagccgttgcttggcgcagtttagccattttaggcatgtaaaggagattgattcatatcaatgcatgcaccaatggatcaaaaattcttgtttcattcgaagagaaatatatatattgtactaatgattttgtgttttgtctttggacaggatctataccttctctagtggttctgcctcttcttttcttcatccccgaatctcctagatggctagtaagcactcgtttatattatccattttcatcaatttgtttggtcaaaatacatttgcatttacgcttatgtttacgtacgtgttaagtttcatgggatttcattgtctcttatacactacaataggtcccgttaaacttcaattaatgtaaggatcgaaacattgcattttaaattcttggtcttaccttctaagaaaacatgtattaccttcttggtcttcttttctaaatgagggatcatctcaatgttcttttttttttaatatctggattctagaagttcaaacacaaagaccctacatatcctagaggcagaatccacaccaagttaaattcatctcctttggagaagagatccctcccaacgtacctcgaacctaacacctctacttggaaaatttaccactgggccaacagctcgttggtcatctaagtgttttaccttataagaaaacaaaattttagtgtttataccaattgtcttttggaaaatataacaatcaaagctgataagactagaaccttactgaactatgatggtcatctaaactcttggttccaaatgtacacgattaaaaacaaccagatcctgtttgtttagcctaagtctcttccgttcatctccaacccataaaatacgattaaagttaccaaaggctagcttatcaatgatttgatcattgatgaattttgtttgtaggctaaagttgggagggaaaaggaggttgaaggggttttattaagcttgcgaggagcaaaatctgatgtatcagatgaagcagcaacgatattagtaaggatatataaatatacatgcattataatagtcatatgatcaacatatatatttacattgatttcccaaatttttgatgatcatcaggaatatacaaaacatgtcgaacaacaagacatcgatagccgcggtttcttcaagttgttccagcgaaaatacgcgttgccactaactgtaagtaacttttcaaaaagaggtaacaacataaaattgaaaacattattatctttgcattttcttaattattcaacccttttgttttacacagattggagttgtccttatatctatgcctcagcttggaggtcttaatggttatactttttacaccgataccattttcacctctaccggtaaataataaccccattcttcttctttgatatttcttcatcaaacggtcaatcattatctgattgaatgatcaggtgtatcaagtgacattggattcatattgacatctattgttcaggttttactaatataagatcataaagcatgactattattcataagtttatttttcctataacaatctatcatcattcttgtagatgactggaggcgttttaggtgttttgcttgtggatatatccggaagacgttctctcctactggtaaacgaaatttaaaactcgaaaaaccgaaagtgtataaataatcgaatcgataagttatttgaaattatttgttttgaagaagattaaagagaagattttttgagtgattgtagttttctcaagctggaatgttcttgggttgtctagcaacagccatttcattcttcttgcaggcatgtttactagtctactaaaccggtggtttggtttcaattttgaaaaaccggaatgtaatcttttttgggtttcttactctacagaagaacaattgctgggaaacaggaacaccaataatggctctcattagtgttatggtaattaataatctatcatcacaataaatagatatattcaaaagaccattatttaaacaatgccaaaactgtaacatggtgttttgtgtattttatcatattaggtgtattttggatcatacggattaggcatgggaccaataccatggatcatagcatcagaggttgattaatcaattttaaaaaactaacccactaactaaatgttaaatcattataacgttactattatttttattagatttaccctgtagacgtgaaaggagcagcaggaacagtgtgtaacttggtcacctctataagctcatggctcgttacttactccttcaattttttgcttcaatggagttctacaggtaattaatctttaatactccctctgttccaaactgattaattttttagaaaaaaaaatatttttaaaagattgatattttaagtttttcatacaatatttattgattagtattgatgaattgtaatttaaaaaaaattaattaattatcattggtttaaagttatagaaaactgtaaaacacaaaaaataatatatttatattcaacatttaatatattttcttaatatgtgtgtcttttctacaaaatcaaactttaagaaacataaagaatatatttttattatatacaaaaaggttttaactatcataaagaaatatttgagaaaaaaaactataaaaaacaaatgatttattccataacattattgcaggaacgtttatgatgtttgccactgtgatgggtcttggatttgtgttcacagccaagcttgttccagagaccaaaggcaaatctttagaagaaattcaatctgcttttactgattctacttctgaagattctacaattttctaagagataaaataaaattaccttcaaactttaatttcagatctctttatatttcatggggtttgtctttcttttttccatcgtatttttacgattgggtcattggcctataaatatttattaaattggtccctgaaagggatctacagttcaactgaaaagcttggttaaggcatatattatgatatatatcatgtttatatgttttcgacgcaacaacaatatacaacctgataaccataaaattacaaaatcttaatagcatctctaatgattgtctctattttttcatttaaatatagagaaaaaagttaaaaaaaaattatttttacactaatagtttttgaaaaatagagatctctatttgttacaaaattttttttagaaaaagtagagatatctatttttgagataaaaataaatatgaattacagtgaaataaaaacaaaattaaaatataaaaataaaaatagagatgagttggagatactctaattataaaaaaaaaacaaatagaattgatggaaaatgagatcttatgacgtgaaatgcttgtttacacatgtctacagcttttacgtaagcgcatttacttgcatttaagattgaaaaatatttgagaaccttatattcacctcctttattttagccaattaaaatctgaaacctaataataataaaaagaattttatttaattataaaatctaagttgccactaaaatgaaattatgtatcggtttggatttattagaaaaagtcaaggtttaaattttatgattaaacgaggttaaatatcggtttgagtttggaaagtgcgattagagtttagatttgatgattaaacgggttaaatattagtttaaatttataaacagatttagattttataattaaacgaggttaaatgtcagtttgggtttagaaaatacgattaggatttagttttttacgattaaataagtttttaaatggcgatttaggtttacaaaggagaattagggtttagattttgtaattaaacgaaattatatattagcttggatttataattataggtttaatttattatgtaatttaaataagatttaacattgcatgtttttattggttaatacaaaaggagctgaataaatgggtgaactcaagtttaattctttaagatttcacatgttttaaatgagtgaaaatccagaccaacaaataaaaatatagatgattcgattttcagaagttggtaacaaacttgcacgatctaagtgaatccaaaacaatagataaaatatggtttttaataaaaacaattaaaataaaatataattatagttataatttaattacctatgttaattttttatatgttttcttagaactaatattatatgtccacgagaaagaaacaaaagcaaacacaatttgtgtttagttttcagttccgctatttttgcagtttttgctccacgagaccaacaatcttccaaactcgaaaaggtttgagcattttcctgaagcaaatttgattcataatcacagatttctgaaaaatggcagaagaaggtttattattaccagcttcttctacttcttcttcttcttcacttttgtctgaaatatcaaatgcatgcacgagaccttttgttcttgctttcattgtcggttcttgcggcgcctttgcctttggatgcattgtgagtttcctaatgcgttcttgcatgtttaattttttattaaacctaattaaaatgttactatttgattctttatgttcacagattggatattcggctccgacacaaacaagtatcatgaaagacttgaatctctccatagctgatgcaagttcaatcacttttttatttttttgttgctcttacggtttattccggtttatttctggttcgatatgatcttggttttcttttctttgctcagtattcactatttggatcgatattgacggtggggttaatccttggagcattaatctgtgggaagttaacagatttagttggtcgtgtcaaagtaagtttcttctacttaagaatgattagtgtttaaaactttcttataacgaattggatatgattatacaattatggttattaatcatctttatgtgattattctctttctaactaagactatatggatcacaaacatcctctttgtaatcggatggttcgctattgcatttgccaaggtttgtttctttctgagttctttctataatggtttagattgtactgtttttaagtcgatatattattatagttcctcaactgtatcttattactatttttgttctttgactttttggttacaaagggtgtttggctgcttgatctcggaaggttactacaagggatctcgatcggaattagcgtatatttggtatgagtgaatactaaaactagaagggtttggtattttttcttatttatggtgtgactttttgatttagaggtagctagttggtaatgtagttatgtagcattgaaacttatttgatatcttgtaacttgtaagttttatgttcagatatatttagttctcttttgtaacaaatcttatgatctgataattattaattacagggaccagtttacatcaccgagatagcaccaagaaacttgcgaggagctgcttcttccttcgcgcaggtaaaactcaagagaaccaaaagcttggaaactattataagcattttccttcactacaagttttgaatgttttacagttattcgccggtgttggtatatcggtcttttatgcacttggaaccatcgttgcctggcgcaatttagccattttgggtatgttaaaaaagaccgattcttatcgatttgcaaaaatcgaaaacttctcatttctcgaagtacaagaaaatgtactaatggtttttctttgaacaggatgtataccttctctaatggttctgcctcttcttttcttcatccccgaatctcctagatggctagtaagcatttggttataacaaaaaacttttggtcgaatatcttaaaatcgtaaatcaaataaaccaagatgaaatttgttggtaggctaaagtaggaagagaaatggaagttgaagcagttttgttaagcctgcgaggagaaaaatctgatgtatcagatgaagcagcagagatattagtaaggaccttctaatctactgggtttcggtttggcatcgagtccagtataataaaccaaatataaaccatgaaatttgaatttatggggaccaaagattcgaacctccaattgagggtgaaactggactttaacttctattttttgtggactaggattgcgatccgaattctgtatagttatggtgttatataaaacttattaggggagacaggtcgttcatcctttttgattttttttataacataaatttctaaacaatttgatgattatcaggaatatacagaacatgttaaacaacaacaagacatcgatgaccgcggtttcttcaagctatttcagcgaaaatatgcattctcacttactgtaagtaactattcaaaaaggttaaaaaaacttcaaaatctagcattattttgtttgcatttgcttgatttatatatttcatttggtttatatacagattggagttgttcttatagctttgcctcagcttggaggtcttaacggttattctttttacactgactccattttcatctctaccggtatataatccttcttcttcttgtttctctttatttgatctaacataatgatatgattacttcatcaaatggtccttaaatactatccgatgatccaggtgtatcgagtgactttggattcatatctacatcagttgttcaggttatagttatactaatacaataccatagagcatggttagacaaaactctttccgtataatattctatacactttttgaccaatcatttttgtagatgtttggaggcattttaggtactgtgcttgttgatgtatctggaagacgtacactcctattggtaaaacaaaatttaaaactcgtatccgaaatcgatatgttaattttgttaggttttcgaacaaagtttaggaatatattttgagtgatcattgtaggtttctcaagctggaatgttcttgggttgtcttaccacagccatttcattcttcttgaaggcatggttactattccatctactctactaaaccggaaattaattttggtttgttataccggaccttaaaattaccggttatttcgttctacaggagaatcattgctgggaaacaggaactcctgtcttggctctctttagtgttatggtaattaataagggttttaggatttagaatttaaaatgttttttagatataaagttttagactatttaaatttgaaaatctaaaataattttctgattttaattttctaatttagtgttgaattttcataattttcccgtaacaactgtattttgatttttgattatttattttattaggtgtattttggatcatacggttctggtatgggatcaataccatggatcatagcatcagaggtaaataaatatttaaaaaaagtttaaaaatatatcgcagacatttaaattatgttacactcattataacaattatgtatcgcatacatctagatttttaaatcattagttcaataacactgaatttcattagagtttttaaaatccgtgattgaataacatcggatttgtaaattttacacaaataacttaaaatactagattgaatacatccctcttaatgtttttattttcttttcaagatttatccagtagatgttaagggagcagcgggaacaatgtgtaacttggtcagctctataagcgcatggcttgttgcttattccttcagttacttgcttcaatggagctccacaggtaaaaatctttaatacaattgaactaaagttgacaaaaagttgatttggttacaatttctgaattttgaaaagagagttgttaactaaaagtctttgttgcaggaacatttctgatgtttgccacagtggctggccttggatttgtgttcatagccaagcttgttccagagaccaaaggcaaatctctagaagagattcaatctcttttcactgattctcctcctcaagattctacaattttctaaacttctcccacaactgtataagatagaagtatgtaaacaaaaaaagtttattgcaatatagtttttacgtgattcacaaatattaacaaacacctttcacaagattcacatgaaactaccaaaacattacaaaataatacaaagttttactcagaagaaaagctttattgagaagaagcacaaagaccacccctttttttttgctgttctgtaattatgagttttgttttaacccactgatccttcaagcttgatgctcataagctggttaacttcagctccaaactcatcaggtaacttgttgaaaacatctctgcagaaaccagagatcattgccgctaatgctctctcgtgatcgattcctctctgctggaaatagaatagctgatcttctccaatcttagaggtactcgcttcgtgctctactttcgccgatggattctttacctgttattgttccagaccaaccacaaaacaaaagtggaaatcaatcacaaaagagcaaaaaactttacagctttctcatagcttataataaagattggatcattggcaatttacctggatgtaaggataggtatttgcagctgctttgtctccgataagcattgagtcgcaagtcgaagtatttttagcaccctcagctttggactgcacctgaacaagaccacggtaacaatttctcgaatgcccggccgaaattccctttgaaatgattctacttttggtattctttcctttgtgaatcatcttagtccctgtatcagcttgctgatagttattagtcaatgccacggagtaaaactcgccaacagaatcatcgccttctaaaaccacgctcgggtacttccaagttatcgcagaccctgtctcaacctgagtccacgagatcttggaacgatccccagcgcaaagaccacgctttgtgacaaaattataaatcccacctttaccttgttcatccccagcataccaattctgcaccgtggagtacttaatctcagctcctttcccacaatagagctcaaccacagcagcatgaagctgattcgtatcataagaaggagcagtacatccttctaaatactcaacaaaactcccttcctcagcaacaatcaaagtcctctcgaactgaccagtctccatcgcgttaatccggaaataagtcgaaataggcatcggacatctagtgttcttcggtatataacagaaagacccatcgctgaaaaccgcagagttcaaagcagcgtagtaattatcatcactaggcacaactctacctaaatacttcttaatcaaatccggatactccctaatagcttcagatatcgaacagaagataacaccagacttctctaaagtcttcctatgagtagtagcaatcgaaacactatcgataaccgcatcaaccgcgacattagccaaacgtttctgctctgttaaaggaacacctaacttatcgaaatactcaagaagctgaggatcaacttcatctaaactattcaaagttggtttctttttaggagcagagtaataacacatatcctggaaattaatcgaaggatatctattatctgaccatttaggttcttctagtttcagaaacttagcataagctttgaacctaaactcaagcatccaatctggttcctctttcaatttcgaaatcaaacgaatcgtctcttcagataaacctttagggattgtgaaggaatcgatatcttcaacgaatccgtacttcttatcgtaatcgagattttggaaatactgttgaagtttatcagttgagctaacggttgatgtacctgatgatgatgattcagaagctccgatgggacgagaatcgattccaacatcggctctgagtttgaagatcggtctcgttggatttagggatttgggagatgggaattttaaggattcgggttttgggtgaaacccttttggtgattttgaggaatcggaagtgggttgtggagagaagctggagataccgtttgcgagaagagacgccattgttgttggtgtggctcttaggagaagtaaaagaagattgtttttttttttttttttggagtcgtgtgttagaaaaaaaacaacgattaggaaaaaaatgaagaagagatgaaatgttaatatttatggaattttctgagccgtagattgaagatagtctcgtgtcagccacgagacgatttttttgttggattttcacttttcagctcaattataaaccacatacgttttccactaactaattataaaaaaaaaataacgttgatctcttctttatttgttaaaaatctcttttagatattagatattttttatacttggacaaaacaaacaaagatattagatattttataatccgatttacgggttggtttcttgtttttgttaatgaaaaaaaaaattagtttgatcttttatttcaaaaacttaataatattttattttaaaatttgttggttcattcatttcagtttagtttggtacactgaaatcagttttaattctttttttttctcatctgaattatattagaaactaaagtagaatacaagttgaaatacataagccaacagaccaacggaatattttgagaaacttagctgaaaaaaaggaagtaaaaccaaaaacatatataaggaaacattttaaaccaacgaaattgaatcaagagacaaaattcaaaagaaaataaaaaactatgggaaaaataagacctaaacttctcctaaaaaatgtgaacgccggaaacaccaataagatcggatagattttacaccgaagtcaaaactaatagtaaatcgacagagaggaaagcaagaagccgctgaaaccagagacataagtacaaacaccatcacacctcacccaccagaccgagatagcaaaatgtactagggacaaggcataaaccttgaagatctactagagataattaaagcactagacacaatcagtatcgattctacttgggttagctgattttcgagccataaactatttcgattctcagctttcacccccggacttttgggcccttaaatttccaccatcaactttcatattcccaaaattacatcatctactttcggattcatgcttaaacatacatttccaattgaaccattcatttaaccgggattaaccacaaatccgcgtttactgtaccgcgattgcgattaacccgactaatacccagacccgttaagaaaacgacgtcgttttcatttcgtttaactcatcaaaaagagaaagaaaacgacgtcgttttcattcttcttcttctgcaaaatcgatttggtcgattagggttcttcattcgacaattttataagaaaatgagcaccaacagctactactcatccgcttccagttcaggatttcgtgtctgtcctcctggtgtcccctcgaaatgttggtgtggagaagagatcattacattcacatcgaaaacaaaggagaatccataccggagattctaccgttgtgcgatagcaatgaaggtacacatttcgattttgtgatatatttgattgattgaaggagtaaatgattggaaattatgttttatagagagaaaatgaagagcacttgttcaaatgggttgatgaagctctcttggacgaaattaagatggtaaatgagaagtgtaagagagttgtagagaatattagtgacctcagaatgaacgtgatggctaatatggagctccttaataaaaacgctaagcagatggaggaagagctgattaagaagatggagggtgaactcttgaccatgaaggagaatgtggaagagctaggacatgttatggcaaagtcagctttgaagactgtaggggttgctgttgtgattgttgcatctattgtatggctttggggaagagtgtaggtgttgttgaggttttggagtgaaattgtagtattggattagtctctgttataaaattgtcgaatgaagaaccctaatcgaccaaatcgattttgcagaagaagaagaatgaaaacgacgtcgttttctttctctttttgatgagttaaacgaaatgaaaacgacgtcgttttcttaacgggtctgggtattagtcaggttaatcgcaatcgcggtacagtaaacgcagatttgtggttaatcccggttaaatgaatggttcaattggaaatgtatgtttaagcatgaattcgaaagtagatgatgtaattttgaggaatatgaaagttgatggtgaaaatttaagggcccaaaagtccgggggtgaaagctgagaatcgaaatagtttatggctcaaaaatcagccacccaattctacttcagtgtttttttttttaattagttgtcaattaattaaagcagtaggtttaaagaaacaacagaaatcgttccttacgaattctatggaattagggcccaaaaatccaaaggaaaggccaccttaaaagcccattttaaaaatcttcgagcccaaacccaaaacgcagaacgaagtttattaagaacaacaaaacgccccaattcgcagcgattatctgtcgttgccacacccaacagactctgcgtcgccggagaaatcttgtcgacgggtaagtctcttcgttaaagcttatgcttcgttaaatcgattaggtcaattttttccctgaggattcgccattttgatcctctctgaaatccaactggttttaagtgatttatgctttggcactagttttgttgagaatcttgtttgataaattcaggaattgaccaccaattttgtgccatttgaatctcctagatcctctctgaacgttatatcttgcttttgagtatatgttaaaagtctaatatgtgattgattactgtaaattttatacttgttcaaggtcttttaaggttttggaagatggatataatctcacagttgcaagaacaagtgaatacgattgctgctatcactttcaatgcttttgggacactgcaaagggatgcaccaccagtccagctttcacctaattatcctgaaccacccgctacaactacggttactgatgatgctacgccttttcctgagcaacctaagcagctcagtgctggcttagttaaggctgctaaacagtttgatgctttggttgctgcacttcctttgtcagaaggtggtgaaggtgctcagctcaaaagaatcgctgaactccaggtcaaacaagtcacaccgatatgtcgagttcttgaatccgattacttctatttgtctaaccgctttgtcctgttttttcttcaggtggaaaatgatcttgttggtcaagaactccaaaagcaactagaggctgcaggtaaaaaacgatcttaggttttcacttcattgttggtgtgtcttatctgtctgtaactggagcagattcattatgcacttcaaatttcaatttgtatactttcttgttgatacacgcactatggttagatgttatctttagtggttctagaatttggaatttttgttttcccttgcaactgcctctgacgattgagctgatgttaatggtgtgaccttgtttgtgacagagaaggagctaaagcaagtacaagagctgtttggacaagctgctgacaattgcctgaacatgaagaaacctgaatgaaatgcttgtttaccttttgtcgagctgatttagaaactatatgatttggttcagcaacaattatcttttaggttcataaggaatatctattctaagttggttcaccaaaaaattgttgtagaagcaattacaagaatgttagttagctcacaacaacagaaccattattttaaccttacacttttttgacctgtctgattacaatctcagagaatccactttatcattttcacaattacaggccatgattgacacatcatgtttgattctccgggcagtgttggtcaaattactatgatggtcaaattactatgaactctggtatctgtcacattcaatccaagttgctgaaaagaaatgaccagtccataagttgtggtccaaaaccggatcttgattgtgtatttgtactcaagcatgtgaagatatcctaactcatcatccttcttgcgctctctcacaagacttgtatagagtccaacaatcttttgtctgcgtgatgaagctttaggatgaaaagaaaactttagccagtccgatcaatattataaattaacaattgtataaatttaccaatatatatatttatataaatattatatgtaaaatatttagtgaaatatgactctactattgtttttctttaatttttattaattttttgtaaagttcaattctaatacttttactatgtgaaaaaaaaaaattgtattttttttttaaacttaataattgttttctacttataatcggattaagaaagattattgattataaagaaaagatcacttttaaaattaaatttttgtaagaaattataaaatttgtaaaatctctttataaattgataattattaatttatccataaattaattaattttctcggtcccaaacaatattaacttatagatgttttacggtagtttgttgatgaaacactcatattctttttaggtttcttcttgttgggtgcttgagaaaatgcagaccgactttcttcgatgatatgttgtacatctttatcatctattggaattttttatatcaatgccttggcaccttctgaatcccctgcagctagtagaacctgatacatcctgccaaaccataaacaagaaccaatgatataccgaaaacctcttgatcttttggaaactgatgatctagttatcagaattgactgcatcctcttgaaactaatcgaacccgtaaatcgaaacccacaggacattgttgaagaggaagacgttgaggcaaaggtggctgtagcagagggtgctgtagcaaaggtggcagaagtggttgtagcagaggtggctaaagctgaagttgtggcagacaatccacgtaagagaaagacgattggtgctaactactatatcccagacaaaagacaacgcttgttctgactttaggcgggagactcatcttagctccttaaggttgttatatagaagactttagttctgagaaaagaatgataaatttgatgtcaaaaaaacaaaaaagaaagaaaattcttttttttttaattggtcaacagaatatggacgtccatataatatttcacttcataattacaatataaagaaattttgtacaaaatcactactttgttgataaaacaatcattttcttttttggtttcttcttgttgggtgcttgagaaaatgcagactgactttcttcgatgatatgttgtacatctttatcatcttttggaatttttgacaccaatgccttggcaccttctgaatcccctgcagctagtagaacctgatacatcctgccaaaccgtaaaccagaaccaatgatatactggaaacctcttgatcttttggaaactgatgatctaattatcagaataaactgcatccacttgaaactaatcgaacccgtaaaccaaaaccctagtggtaaacttgtaactctttttgtgccaatgatagtacaaaattggtcttttgttatgtaatttcaagatatatcttttctttctgttccttaaatctatagttcttgagcaaagagaacaggagtggcttacctcagaaagctcaggacgttgcaagggaatgctgcagattggtactctttccacaccaatagaccgtgctccaggtccttggcattaacacatgcatgtaagagaaaatctagacattttcttgaaggaacaaacccgagctcatctttcataaatcttagcaaatccattcctagatgcactttggatggctctgtctctgcgattgcccaaaacacctgatccaaaacagcatatcactgagaggcttaaattactgaaggctaattcagtaaaagagaacatagctactagttacagactcgatcactcgagcttgatagctgttctaattaaatgttcttgcttagtgctttacttcaaacttcttcgttgagaaaccccacaatgatccaagaacatggaatgtgaaagttgcacatattggagacatctcagggttatcatagatgagtaaatgaacaagtttccagaaagaagcccatgagaaaaacaaaatcaaacctcgtcaaaatgagcttccacaggtatgcctttctttaacaaccggaccttgttccgtttcagcagatcaacaatatcgctatacaacaaaaagagcaaatcaagaatgagacattcaacattgggtagacaagaactaattcgagagcatgggtgatttactctaccttgactttttattgcggacagcgaacaaaatcattctgaagaaaccgtcgatccaactagtatcatcttgtaggtcatcagccagttgaactagcgtacttaactctccctttgaatcagagtattcctacagagataatcaattcactgattatcaatcaactaatatatgatactaagaaaaatgtggctgaaagtgtaatacttactataagagatataatcgatttcgggtctacgtggcattcggctttcctcatttcttcatatatatgtaaggcatctgcccattttccacgtgatgcaagagccgaaataagcacacttttcagttcattttggtttatagccggaacatctggatctacgagcacctatggtagaataaaaatttgagctcttactctaattacataaatgtattccacttttgagatcttaaaaaaaaaaaagagtatgtgtgcctacctgtttcgccttctcaaacttcccagatgctgcatatgcatctatcagggacatgtaaattcgcttagtagcttgaactcctgcttgcttcatctcctcatagtacttaaaaaaggcacaaacatatttctcactcataatacacaaagaaagagagtagagatattttgtagtggcgttgacttgacacgactccaagttaagaagaacaagtagacaaaagatctaaagaacagaaaattctgaattttaccttagtaatagcgtcctcctgggtacagttgtttattagataaccaaaagttatggaatcaggtttaacgccagcttccttcatttgcttgacgaccattaacgcactactcacatttttcttcaaaacatacaaaagccatcagctgaaaacgatctaagagacgttgggagctcacagaaacatggacaatctctcaggtcagaatttgcaaacatgaaatgggagcttaagatattacctccctaaaatatccagccaatatacaattgaacatgctagagtttggttccaaattgaagttctttaaattaccaagcatattatatgcaccttcaaactgcacatgaaaccaaaagatatagagaaacattttgtggttagagaaacaagcgaagcagcaactgtaagaaacagcacagacatgtcctcatctgtaacatagggtttgaggaagttacatctttgattcttgtgcacaaacgtataatgctccggaagttctcagtattaggtttcacactctttgtgcacataattgaatggattcttcgcaccttaaacagcaaaagtatgaggaaatccgtttcatatatgagcagagttcaactgtatattgtctggatatagattcaagctaaatgaggatgcacaccaaatcaaactcaagaacttcatcaatggcatgtaacaatgaatgtaggatatctgcggatatcatcaaacctgcttcacccattttttcaactacatcaagagcagtgactacctacggcacagagagaatactcattatatatagcacacgaaatacagccaaatttattataaaacaagcataataggaatacctcattcgagtcacagctatacttaacaagcttttcgtacgatgtagatgaaggcataacatcaagttcttcatgcatcttgttaaattttaagattgtatcctcaacctttaattgtagaaaaccagtaaaacatggacaattaggaggcatcgattatctaaccaaagactttaacaacactaatctgccactaatattcatgagaagtccttaccgttggatttggggtgcaagtagaatagatagagatgagatcagaaacgttcttcactccttcatctacgcatgttaatgagaaacatataaaacatgctataaaaatgatgttctacaggcataaacatgttattggacaatgcagccttaccactttctcttagctcccaaaggaatctactcgcaacagaatccaatgaaaacctcccaagatattcaaatatgtttgccaataggtccgacgaacgaacttttgttatgtctacaatctctaagagcctctcaagatggtacttttggtcttttttacatagtgcaagcagataattttctgtttttttaaggatcaaaaaggttaaatctttcagagtaagagagagccacaaaacaacagagtgcacaaaactgaatattgcttaccttgcaagactgataagctttcaccgttatcaccatcaattgtactgcaaagttcctcaatcttctctccatcaccaagatggatccaaagaagcatttcatagtaaccaagtctctcaacggaaccgggactagcctccctaatcacatccttgaaactatgaaactcatctaccatatccataccaatcaaataaccaagaagaggaccataaactctttcttcaatcaaaaatccacgatctctcatagatttcaaaagctcaaaagccttctcaatatggccaagagcataatctagatcattgcttttctcagcatgctctaagtaaacaccaatcattgcattgtactctgtcacactcatctctttagctactctatcaaaagcaccaaacatagcctcagtgcctaatttctgagcagagtctctaaatatcttagcgaaacgccgtgacagaccgttctgcttgtaaacacgtctctctttcctttcacgagacaactctttcgttcttaacgaaatatcataagggatcttagtggtgaaacttggtatctttaaaaataagttcttctccaaagagcttttatctgatgttgttactgaaatgtgattcaaactatgaatgaatgagagtttgttgaagaaaatagacaaaattggcaacacataccatgtaacaatttcgatactcgatcttgtaatgatgcttcctcaagatctacacacaattttgcatgaaatcaatcgaattctaaacattacccagatacagaaaaatatcaaatttacaacgaattcattctaaagatcacatttttcttatatttgttcatatcagaaaatccgaattacctgaggaagagtttttggaagagagaagatctttgacagcttgagaagttccggcgatgtctttgttgccggaagcaattgaagattcgccggtgggtctaatacgggatttgaagactgaacttaataagcttttgttaacctttgagacaaccatgttcggatttcaagtgagattgagaagatgaagaagagcaagtttataaaaccctgaacaaaaaccccgacagggttgttctatccaattttaaaccttaggggtgataatttaatcaatcatataaattaggggtaatcatgtaaattaacaagattagttgaagaagaatcgtcaaattttgattttgtcttgtggattcttcaattcaaagattataaatttattgatgaacatcgtcaattcaaagattctctttttatcattcacgctacttcttcttcttcaatcgtcaatcgttgaatccgattcgatttgcctctcttccggcgtagcttcgacggtggcaatggcggctccgggatcggttcagaaaggagatgaagagtggcgtgcgattctttcacctgaacagtttcggattcttcgtcaaaagggcactgagtaaagtttttaacctttcctcagcgattttcatggttcaatttagctttcaaaatttgagcaaatttggtaactatcttccattaggaatcctggttttagaaatctagggtttttatttcataactcgcttaatttgtgattctcagagttaataaaggtttgaacttttttttttttgccaattgttggaacatttatttttcaggggtgtgtcttgatgatgagcactatgttgatgattagatcttctctctgtgtagattacatagaaagtttctgctatagatgttgatctgttaggataaagtctattcttttgagtgattggaaacaatacaaatttcctgctattatagatgttgagctgttaggataagcttacatgaaaggttatagttcttcaaggatactatctttcattactcttaaactccagatgagtttgtttttttttcttattaaagataagatctgagtattggttttaccaagaatgtgctacgactttaagagctcgactttagaacttggttgctctgtcaggttttgtcagttcctatagagcctttactattattagcttctgtcttagaatggattgctatgtaaatgaccattaatatgtctgagttcgtcgttggggttttggtctttctagtatttggatatcttattgaatagggaatgaatgtttatattgcgggtttgtgttttgttgatttcagatatccaggaacaggggaatatgtcaacttcgacaaggaaggagtttacggttgtgtaggatgcaatgctcctctttataaatccaccacaaagttcaacgctggttgtggctggccagctttctttgaaggaatccccggtgccattacccgaacggtaaagaaaatactctcagagcacaaacacttttttcatcaaattggtaacaaaaatgaactctctcttctttgtgtattttgcttacatttgttggtttatcagacagacccagatgggagaagaatagagatcaactgtgcaacatgtggtggacatcttggtcatgttttcaaaggagaaggtttcgctactccaaccgatgaacgccattgcgtgaacagcgtttcgcttaagttcacacccgcagcgtcttccttgtaaatcttggccgaacaagattatttgttctttctctggattttttcactcaagtgagtgggagaaaaacagaacaagaatcttgtatgagtgtgtgtgtctatactgtgtactgtattttttctttcatgactatttaaattcatcacctcgagcattttgacaacaactgtagtctgtagtatgtatgatttgtaacttgaataaaacacactcttgtcttgtaatacaaaatctatactatgttacgcatctgtgagactctattgacacgtgcatgatacaccagtctaaagattcacaacagtttcatatgaatctagactcaaaactaggaaccatacatcactgaaattatgtacaaatagatcactgtaatgattcaagaacctacctgatcattacgcttgcttgcctctgttaatatttcagcttctggttactctctgttgtagtagcttcttcgtggtggttgtcatggcggatcttgtgacggtggttaaaaaaacagaggaggagtggcgtgcagttctttctcctgaacagtttcggattctccgtcaaaagggcactgagtaagtctttgttttctttataaatttgggtttagggtttcatagtttgtgatctcaagttaggccttgttgtttatgtactcatattttgaaagattggattcagaagattgttgatttttgataggttcactatgttgttaccttttcaaggataagcactgtaattaggcttcaagtaatcatagactgaatcttgaaaacaaaattaggggaaaattggatctagatgcacatcaaacaagtgtagtgttgcttcttgcttttggtctttgttttgattgtttcaaacgcggtttctgcaaacggtttgcgttttgcgtttatgttttcaattaacaaagtctttttagcttagaatgcttaagattgttgatttattttgaaaagaaaaaactacactaaacgcaatcgcaaacaaacagtaacgaccttaaaccctaaaccctaaacctaagtgttttattggttttctcagttactatagaactttgtttttagatttatccaagtatagattgctccttcttttgttacgatttttggggtgatttatttcagttcttactttgaaacatagtatacaaatgcataatacaattcaatccaagtgttcttatggttaaaaatatttcagaacgccgggaacagaagaatatgacaagttctttgaggaaggaatcttcagctgcatcggatgcaaaactcctctttataaatccaccacgaagtttgacgccggatgcggctggccagctttctttgaaggactccccggtgccattaaccgagccgtaaagattatcttttgtatgtttaatttagtttattttcatgactactggttagtaaaacattcttctttttgcttgatttgattctacatttaccagcctgatccagatgggagaagaactgagatcacttgtgccgtatgtgatggacatttaggccatgttcataaaggtgaaggttatagtactccaaccgatgaacgcctttgtgttaacagcgtttcgatcaattttaacccggccaaaccttcctctataacctgaggactagttgatcgtacattactttcaaatcagattgtggtgttcaattgtagaatcatcatcacgttacaaggatcaatgtaacagataataagaatcattagtggttcttaaaatatgtctgtttagaaaatatatatatatatatatgtatcctgtttataacgacaattctcattttaatacattttagtaaaaatgttcagcttaatttccccactacaaaagtttccactaaagaaaacagataatatcaaattaatggaataaataagcctaattttctttaaaaattgtaatgtcatttaataattattgtgtaatactaagaaaagatagcccaacaaaaaaatcaaaatatactgaagacgaatacgacgaaggaaaataacagattaatgaatctgttcgcgtgtaaagcttaccaacattcggaagcaacatgtttttttacactttttcgtgctacttaagtattggttgtatggtttgctgaggtttaatgtatatgttcattgatacatttgtattattgatttcaaattaataaagaatgaagatgttaaataaaaaaatattgcgtaatacatttgcatatatttttttctcgaaaagtggaagcacgactctgttgcgcaagccatactcttttggcattctcttttcttaatgataagaagataagaattcgtgtcgtcttttcttttctttttcaaaagaattcgtgtaatggtctagtcacaaatccataaacaagattaggtttctgattaaaaaaatcttgtaatttttagaaataaatatctgatctcttcccaataacaatttttgtcccattagtatgtttaactcagcgatcacttaatataactcagtcgtcacttaagctaactcaaccattacagaacatatctcagtcgtcacttaatataactcagccattatagaacataactcggtcgtcacataacatatttgccaaaaaaaaagagaacataactcagcctttacagaaaaaatcaaaacattaactcagccgtaacataaatattgataaaaaacagaacataacagagccgaaaccgtacctcaccaccattcgctttaatatcttcagcaatgacctattctatagttgcacgggtacggctaccaccccatctaagcaacggaatctcatccgtgttaacaacgttcccaaaacgctcggcgatggtgatgattgactcatacgcccaagcctgcaacacgaaaaccagaccactgacggtgtacgtcttgccaataggcctcagcaactttatagaaacgacaagggcttcatatgctgcccgaccccatggataagtcttcatggcttcgtcgtcgaaaactcttttggcactctcaaatggtatcctagagttagtatgcaagccaaaaagtccaatggatagaagagtcaataacccaaaccatctacgcttttcaggaggccaagctctgcacgttactaagccctgcctaagttcatctagattatgaccttcaccggttggcacacgcaattcactgaagaacgctttgtagtcagcttcaggctcaaacttttctgtaggcagttgatctatatttaaacccgtgatatgatgaaattcgttcaatccaaaccggatgggtttaccagccacgatacaccaaagctccttcttcagtattctcagctgtctgcatagtagataatgtacggtcttaccagaccatagaaaatgactatcaacaagcttagcaattaatccaagctctgtctctttcagttctgcccatatttcttttcctattgattctctaattgcagggaactctcccagctttatattatgattaatgcctttaccctccagattagaatccccctcttggtaaagtcttggagggtactcccttgcttggtcttcagacatctgtataaccataaatcagccgtaagcattccataactcagtgataacataaaacaaactcatccacagataccataactcaggcaaaacataaatctaactcagccatagataacataactacgtcataacataaacctatctcagccacacataacataactcagccataagataaatctaactcagccatattttaacagaaactcagtcaaaccataacataacaacagctcagttaaaacataaaccagactcagctatatcaaaacagaaactcagccataacataaacaaactcagccgtcatataacagaaactcagacatcgatgtaaggttaaaccataactcagtcacaacataaaacaaactcagacacagatgaattgataaatcataaatcagtcggcaaacaaacaataactcagccgtcaaatcaaatagatcttagaaatcggccaccatatgtcaatcaacgacgacgttaaaacccagctttaaaaactatcgttacgcatcggaaaacgatttcagtgacgggaatcacttgcgattgaacttagatgtcagagtcttacttaatggaaacatactcaccggaacttagatgtcgaatgtgacttcgcgcttacggaaatgcgactgcggcgtctgaatttcggccggaacagacgagaaaagagcaaaacggcgaaagaaatcgatttcgttccgtcgagagagaaagaggaagaaagcgacagttttttttttttgggagatgatgaacagtaaagccaagaaataagaaacccaaacgttatgcggtttggagatgattaatgacgtggattatggtaatgacatggaatgatgacatgtataatcactgtttttttatttaatttttagttaaaaacgaattaaataataataattaattaaaactagttaggggtgttaattgtaattacacaattactaaaaacatctgagtaataaaaaaaagatgtgttctattttaggaataaacatacaaatgtgttttatcttaggaattatttcttaaaaaatcttgtaatttttagaaataaatatctgatctcttcccaataacaatttttgtcccattagtaccaaaaccatatttcaatttgggatttatttctataatatcaaacccgaattttgtaaaccgaaccgggacaggataatgggacaaatgagcacttgtattatcacgtgcattaatcattcaccagttttatagtagatcacagtggttcatatgtatctagacgcaaactttgaatcattcatcaacgcaatctaagtacaaatatagatctcactgcaatgtttcaagcaccaacctgatcatcatcaaaaccatttcatccgtagtggtcaatggcggcttctccgttggtggttcagaaaacagaggaggagtggcgtgcggttctttctccggagcagtttcgtattcttcgtcaaaaaggcactgagtacgtttttgttttgtttttctttcccttttggtataatttcttttaatgaaattttgggaatgattttgatagtgcccttacgtatgttggattagccattagacttgagtaatttagggtttcataattagcatcatacatgtgagtatgtgaccttttgatttgagtctttttacccaagaatacctacgtggcttggattcagaacattgttgctcgtttaatatattaattaggctgcaagcaaccgttgaaagattattatagatgtagaaccaattagggaaattggatgatgttttgtttttggaatttggttttgtttgtatcatatataaggagagtattgattcagtgtttcactgtttcatataagtagtttattgaagtatgtaatgatctcaatgttcttaaggtttgttgtgtttttgttgttcaaaatattttagaaagccaggaactggagaatatgacaagtttttcgaggaaggaatcttcgattgcgtaggatgcaagactcctctttataaatcaaccacgaagttcgattccggatgtggctggccagctttctttgaaggactccctggtgccataaaccgaaccgtaatgattctcttttgtatgtctactttaggttaaattttggtgaatgttggtaactaaaatctcttcttttttctttcttgattctacatttatcagcctgatccagatgggagaagaactgagatcacttgtgctgcgtgcgatggacatttaggccatgttttcaaaggagaaggttacggtaatccaaccgatgaacgtcattgcgttaacagtgtttcgatcagttttaacccggcaaaatcttcctctataatctgaggatatgattgatcgatcatacaacatcttctaatcagattgtgttgttaaaattgtcatcatgtagtgaatatgcactttctgtggtggtcaatataatgcaacaaataataagactcattagatattggatggttactggtttctcttaatatgttatagaacatttaataacgatttaattatctaagggatcattactagtgtttcttaattataactctttagaactgaaaaaaaatattatagagatttcgttttgacagaaaaaaactcaaaccgatccattttactttccattttgagtgtgttgattttaaaaaatatgatacgtttttattactaatgaaaatagaagatattatttccaatagtggatctcatatgtgtatccatatcattattttcataattgcgtaaaatatctcgtttcatatatatttgtgtgagataatgggttgagattaggagtgggcattcgagtaagcgggtcgggtttgggtaaaatccaatcgggtacgggtttttcgggtagataaatttaggacccaatagggtaaatataaaatatcggttcgggtttaatcgggtttggctataaatttttgggccttattttgaaactgatagccggatttccgggtaaatacccagatttttcgggtaaatacccggattttcgggtaaaatttcgtgtttcaggtaaaatttagatttttgattaaaatattcgggtatttttgggttcgggtttggatcgggttcggattcggtttttcggatagaggaatttaggacccaataaggtaaatcttcgggttcggtttcggttccaattttttgggtcagtttcggttctggttgttggttccgattttttcccagcccctaattgagacgttggtttgtttgccaataatttgtcatgtggaaaagtactcgaatgtgtttttgattcactataaatggttgtcccgttttgagtttgataattcattagcatgtgactatatcatatatctatttattacactagaagcattattctctttttaaagcaatattctctgttcgaattaaactctagctatcttttacatacctactaatggatattttcatttgggatatcgaccaatcaaaaccacaaattttagctgatcaagatgggatctcaagtttggtaggtatggaaaaatacatacgtacacatccagagagcgaagaatttgtgatgaatttctaataaatatatgagttgttgagaaaacaatatttcaactaatcttatatttataatggtcccatgcatgatacaaacgtggtcgttatctcgtccatatgaccagtgaccacatatgtttcaatacgtgtttcatctcaatgcttcacaacctccatttgtattgttccgcacaacttaatgttatgtacaagttgaatatgcttattatgtagtaaaatgtaaaagacataaatcaattcattagtagtaaaacaatatattctcgttgtcatcagtcattactcatcatttggcaccaaaatgcggaagccaagccagctgtgaatggtaagtatattaatctctattcacatgcaacatgcactagtgtgtcagtaatttggtccatgacaatacacatgtgtgatctagatgtccttgcttcttcaaaggttacagcacaaccatatctagtatattactagaaagagaaaagaaattttgttatagcattcatctaaaatgatcagagaaaagaaattttgttatagcattcacctaaaatgatcagaacaaatctgaatgaaaattcagtatatatatatttagacgtttagattgtgcagacaaaatgtatttagtgctacaactgatgtgtaatgtatggactactttcataaaaagtgcagaataatatgcacggaacaatattattacaagttctaagattattcatatctacaaagattgatatttttaataataaataattcgagtttccaaatcgatttttaccatttttattttaaattgaaaaagcaaaacattcatgcaagaaaagttaaaaacaagttagtggaaccaacaaaaaaaaaacagtgttaatgaatgtcccaagtccgaacttttataatggtatcttttcccatgatttattcatgatttagacaataatagggatttacggattttgccattttttgctataatttttacgaatttgttattttgttaaaattttacggatatactatttttctatatattaaaaaatgttcacatttatgagtctttttttgcttaaatacacattttataagttataacaaataataaattctataaacaaatagaaccgattaatttaaatataataggtaaaacacatgttaaatcgtatttttatattataaatttttttttattcataaaactttagacaaaaattgcaaaatccataaatatcactaagaaaatggcaaaatccgtaattgattccaaaaatatgacaaacttttgaatcttttaaccaaaaaaagaaaacagaggtttttataacaagttcagtttacaattttcaacgtgtggtttctctattagaaccaaaagaataatatatatccaaacgtgcacaacgtgtcaatttttttgttacaaaatgtgaagaacaaaaaaaagtgtgaaaagctggttatgagttatggatctgcgcctataaatatacaaacatttctccatccactccatagccaaaccatactctccaaagtccaagctcacaatgaacacttcgtaagtctctctccctctctcaaaatgttctttttgtctgaaatgtaaacacaattttttgttgctctcgttgctcagcccaaaaatggaaatggaaatgaaaatggaaacgaaggcggctcctgaagctggtatgatcaaaaagtccaacgaggagtggcgtacggttctatctcctgaacagtttaagattcttagagagaaatctattgagtaattagatccaaactttttttcttcttcctctcttaaattcattttaggtattttgttttcttaagcctcacggtaggtttgatgacgtttttttcttgttttcgactgatgaatgtagaaagagagggtcaggagaatatgtgaagttgttcgaggaaggaatctactgttgtgttggttgtggaaatccggtttataaatcaaccactaaattcgattccggttgcggttggccggctttttttgatgctattcctggcgccattaaccgaaccgtaaacctaatctcctcttttttttttcttttttttaatgaatattgaatttttatcataactctaaagaaacctaaactaatctctgataaatatattttctattttcataaaaaaaaatgggcatgcttgcatttaaaacgtctataataatcattttatgtatatttaaaaatattggtatgcttgtccgtattagtcacgtgtataggaaagtgcagacgggttagctaactatgcttttttttgtcattagagttttattctttggaggttgttcctattgattttgtttctgttgtaagcgatgatgtgcttaggttgggtctacgtgactaaggcaagtgtctatgtagtttttttttgaagttttaataaaatttagatagattttttcccggtgactagaagcttcatcgagataggagcgatactacgaataaggtatatggggcagagtgccctaccaaaaaaaaaacactaaaaaaataatgaagatatgtggagtttaatgtagttattttgaaaagaaatgtgattgaatcctaactatactcatctaaccaagcttataattcgtataattcgtataattcgtattgggctgcatgtttgagaaagactgaccatattttttagtatcataaagttcgatcagtaaaaataagaaatgatagcttagttagattctagtaatactatcatgttttaattgtttatatataacaattgtatcttacgtaatataattcatataacaattgcatgttgtaaaattataaaatatcttttcatttaaaagattcgactaaatacatatctcaaaaatgacatttttagtatttattaaataacaacaattgtttttaaaacacatgcaatttgaattgaatgaatgaaaataacacaacatcactagaatataaatcactactttagaaaatcatagtcaatgacatactttttaaacaatatttttgcaggaggagagagctggattaagatatgagataacttgcacaaaatgtgatggacatctaggtcatgtcttaaaaaatgaaggttttccaacaccaactgacgaacgccattgcgtcaacagcgttgctctcaagttctcttccgctatcacatctcagtgataaacggatccggtttagttctccggaatcaactctatctatctatgaacgttgattactaagagacctttctacttctgttagaatgagaacgttgtgttcttcaattcatcgcatttatgaactattataaaattgaatgttttgtgttttcattatttttagtaatgcttatgtacgtatcattgaaattgtttgtgtcatatattgtgccatttttctattgagtgttaatgtattatcgtatttaccaaaattatatatagttattgtctaagtctgcgaatcatttgccatttggatacacatgcatgtctaaacaaacgtacacatggggatgtgaccgaactatttttttgtttgtttgttcttttaatatcattgacgtttttaccttacttctcaattgttcttctttttccgtaatcgacaccgtagagtttcgacgatgacatgacgcggccaaattcaaagcaattttaatccattcagttcttgtctatgattagatgccttgagttccttcctgtcatcaaaacgaatttaactagatccattggattttcaatatgttggtggcggagatgtatttttttaatcgcaaacaaaagagataaagtttgtgaaattggtagagaatgtgttgatggagttgacagatatggtgatggagttgatggagaatgctttgatgaagaaatcacggtgttgatgaagtaatcgcggtaaaacaaagtgatggagacaggaaaaaaaatgacggaaacgatgatgaacggtgtttgagatagggtaaaattgtcaataaaattttaataagtatccaatcctgtaaacccaataagagagtgtcatttttcaaaatttttggccccaaatatatctgattgtataaaagtccctaccaatcacaccctatgttttccgttattgttttagtcatatataccatattcaaattttatgtaaattttatgtaaatatgttcttcaaattttttaaaaaatcctggctgacccggtccaagtatgtcagttagctaatagttgtgtttgttagtcggagaagtctatttagctatataccacctttcatgatactattactatcccctgttgttttttttactaatacgttattgggatgagatgccatctaaaaggggaacttctccaattctgttcgttgggaccactccagattttacaatcccggcttatgagttttgagaccactctcacttattttatctacattttgtaagagtgccgtgtttcatacttagttatttctctgataacaaacaaattggggttctgttcttaaaatatataaaagcccgtgaggcccaacaaacggaaagtttggcccgtgaaagaaagaaaaacaaaacttatttattgaaaaatgacacgtgcagaatcatttactaaaccagacaataaccggttaacggtttaatagttagcaacagaagaaccaaaggattgtcttcttccacaatcagaatctgtctgtgtggcttgtaacgcttcaatgtcagtgaagtctttagctatatccacaaaaataacataacaagattaaaaaaaagagagaatattttatctctctagacttgacaatttccctctctttctcactccctatacctgtatatgtatatagaatcgtatatatctggagaaatacacgaggtgttctcgtctctgacgacgtggtctattgtcttcctcagctttagtcaatttcttctttcggaaacttggttctgtgatattatccaaacttaaagtttgagtctttagggtttatgggtgacaacaaaagtacatgcctttaggctttagttttgtgggtttcatctcaaaatggcaattagtactatgttagggtccatctcttgttgcccctctcccaaggtatttccttccttgtgcttacttgtgtatctgtcgactgaaaaacctctcctttatgtatttaagtttatgtgcaaagccttaattggtgattgaatccttagttctgatttgatttcaggggtatgagatggtgaaacaacatagtgttcgattaaagcattgcgttttcacggtgaaatcgagtgtgcctgtgtattcggaaggcgtaaacgatgggattaagttgcattcttttgggaatttagttaaaaagaaggtttttctggatacctctaagagattctatttccaagggagatggtctgaatcgtcagggaggagagtggagacttatgctggagtagatgtagcgagtgctgttgatgtaatcaacgatcttggattcgatactttgaccttcttgatggttactgttattattgtccctgcattcagaattctcaaagctagtccggtacaacaaaaagctacaagaagttggtttgtattctcggttataactacttggcgataacatttgtgtttttggtggtttcccagatacttggtttcttctttgctggtgttgtactcaaccaatttggtttgattagaaatctcacagatgttaaagttctttcagaatgggggattcttttcctggtgagcattgtgcataattatgttcataggctttacgtgttgaatgagtagtaatgactggccttatcctgattatctttggcagctctttgagatgggtctcgagctttcacttgctcgtctgaaagctcttgcaaaatttgcttttggcatgggactaactcaggtttggttctaaaagatgtttcttggtttgctttaaactccttacattccttcttatattttcacttctgtcagataagcatctcaagagtcatcagtgatctttacgacccgatttcgttatgaaactttatagaccatatcattattgccagatcattgctgcaaagatgtcatatatcgtttgtttaacgttaccttactttgtactgtttttcattggttcaaaggttttgttatgcacggctgcattcactgcttttgaactcccaccaaatggagccatcggaacaaaaattctggaattcctctttcattcaaggcctgacttggtaaggtttttcacttggggtattatcatgattctcttgtcgtttttagtatcttttgtatcatgtatttcaaatttagcagacgcctcttttcccaatgtgatcatggtctaataactgtcaatctctgatgttttttgttgggctgttagagctatatcctaatatgatctataatttctgtaaaactctaggtcaacattagaagcattgatgaggccgttgtcattggcgctgctctatcattgtcatcttcagcttttgttctacaggtattagcacagttgcaataacttttagtcatctatatctagaatggtaatggagaggcaaactcaatcaagaatttagtacattcttattgacaattttgaaatgtatagcttcttgcagagaaaggtgagctccctacaagatttggctcagcaaccttgggaattcttcttctacaggttctgcttatcctgtataatctctatcttctattctatgactttttatctgacattccaaaagatatgtcaatatgtatttgggaaaagaatctcctgttttgaaaattcatccaagataagcaaaaatcttgtgcaaactcctgaagttgacaaaccttttcacttacgcttctcgcattgcttgcaggatatagctgttgtgccgttactagtcattcttccagtgttggaaagccaggtaacttggttatcgccttcttgagcttttgtggactgtttgttataagaagctataaaagctgcattgaacttttattagtatcatttaaacctttgtttatatctgaatctctgtgtttttgaaaggatattggtggggaaagcatatggccaatgcttgcaaaagaaagtgcaaaggctcttggtgggttgggcatcctctctcttggaggaaagttctttctccgtagaattttcgaggtaacttatttcgtgtccttatagtttgacaaaaccctttcctttgaatcccccctttttagagagtgaatacaggacactgttttatttggtgcagtgcttaaatactaagcccaaaacaatattcaggttgttgcagaaacaagaagctcagaagcttttgtggccctttgccttctcacagttgctgggacttcacttgtgactcaatggcttggtttcagcgatacggttagaattaacacccctacaaaaatataatttccatctaatatccttactttaatgtcctaactcaattttactctgaagcttggagcttttcttgctggagcacttctagcagaaacaaatttccgaacacaaattgaagctgatattaggccatttagaggtttacttctcggtttgttctttgtaaccacaggaacttccattgacatggaggtaaactgttatactgcattgcataagaactcagttatttccactgaaaaatatgatacatttcatgttcatgctcatgtggttaaaatcttttgcaggttctgtttcgagaatggcctaatgtcctctcactcttgggtggtctgattgtgatcaaaacactgattataaccgcaatcggtccccgagttggcctcacaatacaagaaagcgtaagagttggctttcttctttcccagggaggagaatttgcatttgttgtgttctctctagccaacaggtttttccaactgccaatattattgctcaaacatctcctcattatttcattagtttcgacattttccttactaattaggtggtcatgattgttgcaatcatttgtgcaggctaggagtgcttccaaatgagctgaacaaactgctcattatcgtagttgttttgtctatggcattaacaccttatcttaaccaacttggaagaaaagccgccgattttcttgatgagagacttgatcccggagaggtaacttttaaattttctacttttgcatttatatgaaaaataaaatttgcattcatcttgaatctgttgacaattgtgcagaaaataggtgaagatgtgaacttcgatgttagtgaatcaattgtcatcattggatttggacaaatgggtcaggtaaaagtcatcatttgctttcctggaaaagttgtgctaagtggtttctcatcgagtcgatatgattttgcaggttctggccaattttttgtcaacgccattggtctcagatagtgatcttgtgggatggccttatattggttttgatctgaatcctgctgtagtgaaggtctgtaacagataacttcgtttgttcctgacctgatcaaatttttggcattctaaactagttttttctttatggtggtggtttggtaggaatcaaggaaactcggtttcccgatattgtatggagacggatctcgaccatcggttttgcaatctgcaggggtttcatctcctaaagctatcatgataatgtataaaggcaagaagagaaccactgaggctgttcaaagactccgtcttgccttccccggggttatttctctcttccttcttccttttgtcaataaaatcgtttgagacatcaagtttaagtgacaacaactgttccttttaacatattaccagagtcctatttacgcaagagctcaagatttaccgcatctccttgaactaaagaaagcaggagccacagatgcaattctcgaaaatgcagaggtaaaaaacttccaaaagatgtctgctcttttatgatcacagtaagatttctttctgaacgagtttggttgtttgtttcgggtttatagacaagtttacagctcggttcgaagctgttgacaggatttggagtaatgtctgacgacgtaagctttctaagtaaagttttcagagattcaatggagatacaagctcaagaagaaatcacagctagtgaaacaaatgctggtttgaagccaatgcaaatgaaagcatctgatataaacgtagtgtctgctgcaacacaaaaacaagtccagctcatgaagccaatgcaaatgaaagcttctgattcaaactcagattctgcagcagagattcttcaagaaacagctggtttgagtcagcctcctgagattgatgattcttctgtgaatatagataatggatttgttggtaaagctgataaagctcaagattaaaattgctcaaaaattctaacacttttttttttttttctgaaatgtgcagccaatattccaaactaaaagaaacaattttttcttttcttttctgtgattattattattattattatttttcctcactatcactgtcgctaaaaagccaatagttagctcaaattcattaaatatcttcactgtctaggtactattgaatcatggatattagtgccaatataaattcgaacataatccaatgttggtctttacaatgaaatgaattgaaacagatttgattatattactaaagaaacaaaaaaaaatatagtaaaaaaatatgaaatccacacaaattaaacatggaaatttagaaagaaaaaaagtagtttctaaatcttaaaacatagatattgattttaatccttgatcaaataatccctcataaaattgtaatttaagtcgttttgtttagggttatattactatctatactcagatgatcggaaaattaataaactatgcatgataaaaaatggggttgcgggtatgatatttatggggttgtgggtattataaacataacgatataatatctatttgtgtttcgacacgaatcaaagatagtgggacgcttaagtaacattaatatcacgataatctcttatctgctaacacgagcctttttattcgaagccttttaaaataagtctcaaacaattgtgtacgaggataatttgataacaggataatttcatatcgattccacacgttgtcgctttgggttttgaacaagaatcaaaacttatattgctatttaataatattagtatcgcgataatctcgtatctgctaacgcaaaactaataacactctctgattactaaccgtgtacggctaacatgataagtttgtatctgataaacacgataacgtttagttagtttttttttaaaaacccataagcaaaagcctacaagtggaaatggtaacgaagttagtcgttaaaactactagcagataattaaaataataacgagacgatgtcaatttgtgttttgacacgaatcaaagctagtgagacgcttcggtaacattaaaacatacactcttatccgctaacgcgagcctcttgtttgtagccttttaaattaagtctcaacgagcttagctggtgacaatgttagtcgatataccttctagcaaataagcaaaacaataatgagagtttcgcaggttgtattctgatgttttgcaaaaataatcaaaactatttacattttctgataatcaacggtatcacgataatcttataaccaataacaaaataatttcgtggctgctaatcacgatatcattttagttaatttattaaaaaaatcccataaacaaaggccgagaggttgaaatggtaacaatgttgggcgataacacattctgataacattagtatcacgctaatcccttatcttctgataaacattaatcctctcgccgcgaagttctttgccaaaagcaatcagacggggagggagaagaatcggcagcatcgttcctagaaaaaaaaacataaatccttgtaaaacaactcaagataggaagtcaaaatcaaaataaaaaggaaacatctatatcgattactagcaaaagacgcgaggaacaaagcacaaatctgatagatgaacttctgttcgaaaaacagaacgaaataaaacaagaatttggaggaatcatttctttttttcttacgcctcaaaacgacagtctcttatcttcatacaaaactggaaagagacgagtaactacgtaagaaaaaaaaaccattaataaaataacacaacttcccaaatatatctacataaaatcttcttctacactactgcaataatatccctctacaagctacaacttacgcaatcgataatataggggtacatgtgtaaaatttttgttaacagtgttgggcaaacagtgcaaaatgaagagagtgaattaacaagttttcgaagcatatcaagtgatatttttgtttatatgagttttgaggactgacttcgtctaaggtttgttcgtggcaataaaaataaaggttcgagttttttgggagctgagacaatcacgcagatgtctgagcttcacagattattctcagacaatgtttattcttcaaacgactactgatatcgtttgtgctttctttgtagtattttttgttgtaatcataggttttttagttttagttatagattttagttttctgtttttcttttctaaaatgatatataaattataaatactttttttgttatcagatattgtttaagactcgacccaaaattataaatacattgatgaaaaaaaatagtatatagctgatgtaatccacgcgcttgctgattagtcgtgctcatgtaattaaacaaatatcgcaaatgttaaactattatacacatataaatttctgtatatacaaaacaaacgaagaagacgaatctctcagtttcgtcgttcgtttcgaagttgtgcgttggtgaaatttgaaatctgaatacactcattgcaaaccttagaagaagaagaagaagaagaagaagaagcttccatagattccgttgggcttttactgtgtttgattgatcggatcgattgcgattacggagaagatatggctcaggctgtagaagaatggtataaacagatgccgattatcactcgctcttatctcacggcggctgttatcaccaccgtcggatgttccctcgatgtacgtgcttgcttgcttattcgcgaatcttttttggggttctctgaaattctctaaattagggtttcatattctgattgtttttgttttgcagatcatatctccatataacctttatttgaatccgacacttgtggtgaagcaataccaatattggcgtctcgttactaatttcttgtatttccggaagatgggtaattttcccttaacactactctatgaaactggatacaacatttgtgtgcttattactttcatatgaagctcttgtctttgtcacattattagctctaggctgctacttgttaatagcgttgtgactgattgattgcttataaacaaatatgtgtttggggttgttgtagatttggacttcatgttccatatgttctttctcgcacgatactgcaaactccttgaagaaaactcattcaggggaaagactgctgatttcctatacatgctcctatttggagcatctgttttaaccggtattgtacttatcggtggaatgataccatacttgtcagcatcatttgctaaaatcatcttcctcagcaactcattaactttcatgatggttggtaacttctgtttcccacaaatctaagtcgcctctaaatatcagcttatagtctcttgtgttccacaggtctatgtatggagcaaacaaaatccttatattcacatgagtttccttggtctgttcaccttcacagcagcttacctaccatgggtgagtttaactctctcgtttccctaaacttccaccggaatgaataaataacatcttctgcaaattctggcttttgcaggtgcttcttggcttctctatccttgttggtgccagtgcttgggtggatcttttggtatatactcagattatcccaaaaaatttcttctccagtctcttttgatcttttgtcacccaagttaacttcagtctgatcaaaacatttcagggtatgatagcaggtcacgcttactactttctggctgaggtttatccgcgaatgactaatcgtcgtccattaaagactccatcattcctcaaagcgttatttgcagatgaaccagttgtggttgcacggccagaagatgtgaggtttgctgctgcgcctttcgatgaaatccaccaagactgattctgtcatcttacatttcccaaacctaaacacccgaatcagtagtttggcttgtggatcagatataaatggtgcaaaggcagatgatacacaaaagtctattttgactctgacacgtagttgcgacccacacaccctagtttctagtagttgggtgtgttttggttccttctctttcctcccatctcttcatctttttgtgtatacaaacatcgtttgcttttagtggttattgatatgaacacactcaatttgtacacaacctctactagtgtcgcaatgttttagcgagggaacatgttttgaattcactgcccgactcagatatcagaagaaatgtacttttgttcagatatcagaacaaatgtttcattgcttttagtacattttttttccttttctatttcagttagcagtagaaaacagtgagagctgcgtattccggaaaacaacaagacatgttcaagcttctttaattaagcatgtgcctcgtgtgtgaagtttataaatgttggaaactagaaactatgatctcttaatcatagatataggtctcttcttccagtattgtacaccataagctgcagttgaagccatagtcgtcgaagcaactaaccagctggatacaaaacaacatgagaccaataacaagatttcagagaacacacttcatatgtttataactttaagggtagtgattagtccagctgtgtggtaattcgaaaaagacctattaccttagataagtgatccatgtctgggtgtctggattcccaaactctggttgaagtattgcaccagcgactagagtcaactggaaaactgtattcacctgtcgatagacatgttccattaacaaatcagttacacataccaaagatgccaagatgagaacaagctgtatcacctagagatcataccttgcttataaacaatggttctactttctgaggacttgaaccatctagattgaagaagtcactccaagttttccactgaaagaaacaagaccaatatgattcccatcaataaatttattcgtgttcttgttaaagcatatggtcgagcaggaaaaaaatgtagggaaacaagagaaattagtttagtggtctagctcaagttacaaaaattcaccttccagtccaagtttagtgcccttaggtaaactgcaccaccaacgagtgcaacatcccgtaacaacacaattccaaccagtccagctttagagcacaaatgtcccatgcatccaccaaaattgagtatagtatcaaagatttttaagaagtttaaaaggtagtagtgcaatctaggactaacacacacagccgagtttagcaactagttaattaacttagtacggtttcctcttgatacatccatgcaatcttgtaaggaggtttgttcaaggagatcaaataactgtgcttatgaaattatgaatacgacaattctgatacatttttcccaggcgatcactcaattggagtgtaaatcaaagcacatgttccttataagagaaaattccgcccttcaactttgtgaactctagctatttcaaagtttcaattgtaactgctaacttattatctaccaggagtaaaagaggtagaagaatactcacgatgtaagagatccttctgcaccattgctactgctacacacccgataagaacctgaattcaaaacacgagcacaatcaagaaaacggaattgaaatgaaatgaaacctcacacatgtttgcagcttgaaactaaccttaactctcaaacacattcagagaacatccacaatgagccaacaaagtaaaacacataatagataaagaaagactttaccttgtctgcaagaggatcaaggtacgagccaaccacagagttaatcttcatcctccgagccacgtaaccatctaactacaaaatcaagcatctattaatacaatgttcttcttccaatactacaaaaaagaaaaaagaatcacaaagaagatgcatacccaatcactagctccagaaacagccaaccctaagaaagcagaagaatacatctcattcgagatcatcctacaatagaaccacaaacaaagtctcagattcttcattctcctaatattatcttcctgaggaatatatacttctatacttaccaccaaagcacaggaccagatactaatctcgccattgatatcatattcggcacattaacaaaactcttgactaattttccaccatcttcttccttggaatcgttgcgatccaccgtcaatatgtttggtaccacagactgtaaccctaactgtctcggaaacctagttctgcttctaattcgatccaatctaagattcagagcttcgacttttttcaaaacagagccgtttccgcgccagtgcaaaggtgtcgcagactggagaagtttccaaggaggagaagataagaagagaggtccattaagaggaacgaaccatttcgaaagcggagataaacggtgtgagaaatgtgggaacaacggcgaaaactgcggtggagtcagagaaacggttccgccggaagctgtagcggcggtgaagaatggtcttgttttccggtgattgatttcaactagctttcttagagatctgtaaatcgccattgatcatcaacaaagcagcttcgtcttcctcattaattttaatttaattactgtttagttaggaatttgaattttgttttgattcctttaacaccggaaaggaggaagaagatgtatcagagaggcgactaggttttcgctgctggcttgtgccacgtgtaatcttcatgaaacacgtggatgctttatgtacacgtggtgagatcattcggtatagctataccgaatcgggatattaaccggaataagaaatcggattagcaacgttcagcccgattcggaaaattggatcaaatgtttgtttagggctgagcataaaatcagaaatccgaaaccgatccgaaaaattcggtttcgaaatcgaaccaaaaagttaaaaaatctgaccggataacgaattttcttatctgaattattcgaaccgaatcatatctgaaccgaaaatcgaactgatatccgctaatccgaaataaaattatatatttaaaaatattagttatatttagttataatttataaccaaaaaataataaataacacaaatatctgaaataactttgatatccaattttgttttagttatatttgttataattatacaaagtttgcaaacttaaaccaaattttagtaaaagtaaacgatttattattaaaattaaacaatttttagtcttttttttctcaaaaactgttgcgaaaccgatctgaatccaatatcatccaaaccgaaaccaaactgtatagtcatataatccgaacggataataaacttcttcatccaaattatgcgaattcaaaaaaattcgatctgattccgatccgaaatccgaatggccagacctatgcctatatttgttgaaatcaatttttatttttaacagagaacaaaagtttgaaaattttaaattataattatattattacaatcaatattcgagatgaatgttattttttcgaaccaaccaatgaaccaaaacaccttttgttcggtttggtataaaccaacaaaatgaagtaaaccggtaaaatctgaagcactcaacagtctcactaaacgtgctctggcgaggctgaatcaaaaatgaacctaagttgttgcttaacttcatcttctgcaaatgttgcgtctatggctgctctagccaatgcaaaggtttcacttttactaagaccttcacagaagaaacaaaattagattatttggaaatgtagtttctttgtgaatctaaacttaatcacaattctcaaaaatcagaaaagctctgtaactgttggatttgagctcaggttctggaagctcaccaagagaacgaacagcgagggcgtactcgttggagaggctagtggagaatactccaaaatcatcagtgcatagaatcaatggatgctttgcattgtaaagatcagctgttaagatcagactaagatcttgtcaagattgctttgattttaaatgaacaaggaggaatgtagaaaacgaagcagcggaaagagaaaatctaaccgaaatggtgtatatcgatggaagatatcgatttggttacaatgttggatgttaaacatatttcaacctgcaaaacatagcaaactcttgaaattggttaaagagattataagaaacagagaataatggtacatgcaaatctattaccggaatccggaaagatttcaactttgtccaatcttcgtctttgaagaaacaggcatgtccaatccgatgcggtttaaaatcaagcatggcttggatctctttcggattgggaacctacaaagcactaagatagagaaagtagtagacaatctgaaacataaacatttgaaaatcggttaagtggattttcaagagttaatacctctccacagtgaagagtgatgtgaagatcattgtctttggcatattgtaatgcaggcaagaaagtgctcctacaagaacatggaagatttcaaaaccaactcataaagcgaagcaaaagataaagaggagaactaagaacagtttaccattctccaacaagaggattccccgaaagatcgataccaactaccccgacatctctcatttccaatgcgagcttaacctttaaagaaaaaaggagagtatcaaatgttttctgcattagtcttttaagtattctgagtagcttagcttgttttgaaacactaacagtttccattgcggactctgttgtttccctacgatcaatactaagaagaagtctaacataaatcttctttcttccaatcccatcaccagcattgtgcagtttttgagaatcagatgcggtaacaaaatcaatatcgacttcactgacagatcttagaccttggattacagcttccatgtaagaacgtttactcatacctattgaatcactcctctacaaacaaacaatctccatcattcatataacttaaccacttgcaaaaaatatgccaaaaggtgtgtacctttggagtagttcgtaactcaagatacaccacattctctaaagcaaaatcttccacaacctgtcaagataagatcatcagtcaagtctatagaattactaaaatcaagctaatgaatggaaattagaattagggttttacttctcttgtgatccttgtcacagttttgtgatcagtagtgagcttatggatcaaatcaaacaacttgaagacttcaaccaaagatcgatcatcttaaaaaaaaacatcatcacacataccaaacattagaaactacttgcgacactagagtagactaaaacttaagcaaaatacagaacaacgaattcaaaaaattaaagactcttacttttttgaatgacatgttcaacatcagcaaacactataacgcctttctcaccaagaaccctagcaagctctctgattcatcaaaagaaacgaaacccatcagttcaaaatatcaaattgggtaaattcataattgatcagtgcaattgcagaaagttgcagatacgaaagatagagttaatggaaacaaaactcgtaagaaagaagataaatttgggggatttacagaagagtggagtctctaatggaaccgttgagatgagcatgaagctcgattttgggcagtgattgtatccattccattttttttttgtccagaagaagagaagagacacaattacggattaggaagacaaacacagacgcaagttgagtagtgaagaagcgtgtaaattttatcagttcagttgaaaaaagaaaagtaactaaataatcaaaaatagttttgagcccaaaaacttcgtttccttacggaccatacattagaccggcgacacaaatttagcaaagctacaataatgaatttatcataatttgtttataaatactttgataaaatcttttatatgttagtgttcatgatacatctacactatataaaagttgagactatttgcttaccaaatctttaaaacgacaaattggaagctgctacatcaataatttacatatttagcagctatttaattaacgttttcgaaaacaaccaatcgggagttgccacattaataattaaaatatttaaaatctaattaattaacatttttgaaaataataattactttctattttaaaatttaaaataaaaaagaaaactaacaaatattaaatttaaacttataaaataggaagctatataattataatcttgtaatattaaactcaaatctttatgattttctacaactaatccaacatttttaaatataacttaaagaaacgtaacaaggacgtggtttgatggtggtgtttttaaccgtgtcaatttgaatcaagttctcgaagatataaattgaggtttttcagtctagaaagcgtgaaggtgaaaacgatctaaaatgcatcaaaagagaaaagtgatagagttaagtaccaatttagaagttaaagcattttcttagaataacataaaacaaaacagagtacatcttgacgagcttgaaaaatgcttatcaacaccataaaaacactacaagtctctcttctgctgacacctccgctttttcagttaatcacagcttgacacctcattaaaatcaacagccaatcagaacattttgattaatacacctcatttacgttgaccaataaaaacttactatttttccatgtcatcccatcaacttaacaaaattaaaattagacatgggcctaccccaaccaaactattttcaaaattaaaatctatataaaaacataggcctaaacttcctaatctagaaaacttaggcctcggaaaataaaccgcagcgaatgtaccgaaccaaaactgatgaaaaaaactaaaccgaaccgaacaaaatatttgaaaataactgaatggatattaaattctataactgaaaccgaatggatacagaccaaaagattttggataaccaaaaatatccaaaatataattatatttttaaaaatattagttatttctaaacctaataattaaaaatagatatacgtataatagtaaaaatactcgaaagtaaccaaaaatatatgaaaatatcaaaaataactaaaatatctaaaaatatttaaacaaaaataaccgaatagatattaatttttaaaaccgaatccgaactgaaacgaaccataattttaaaataaccgaatccaattcgatgcggttttaaaaattttaaaaccgaatccgaactgaaaccgaaccataattttaaaataaccgaaaccgaatggatagagaccaaaagattttggataaccgaaaatatccaaaatataattatattttaaaaatattagttatttctaaacctaataattaaaaatagatatacgtataatagtaaaaatactcgaaagtaaccaaaaatatatgaaaatatcaaaaataactaaaatatctaaaaatatttaaagaaaaataaccgaatagatattaatttttaaaaccgaatccgaactgaaaccgaaccataattttaaaataaccgaatggatactaaactttataactgaaagaactaataaccgaatggatacgaatcgatactgaatggataatcgaatgcccatgactaagaaaacttatctaaaggcttgactggttgaaacgcagtgcctgcatttgtgactgcatgagtttacggaatcagacagttgcggtttcaagcattataaacctttttgaacgactggtttaacggttaaaaattggtgcatttttggaaggtttatgactggttaacggatttacgtttatggtagaaaaattacgggtttatgtttttagcaagctaattacgggtttacgtttttggcagaaaaattacgggtttacattttttttgcggcaaaattacggctttacgttttttggcgggaaaattgaaggtttaggttttttggcggaaattacgggtttacgtttttggcggaaaaattacggatttctttttttggcgggaaaattacgggattacttttttggcaaaaaaattaagattttatgtttttggcatgaaaattacgagtttatgataatgttatcatcaatgatgatatctatcatgactatggtatgttgatatgatgatgaagaagatagtatgatgatgatggtgatggtaatatgatattatgagagggtaatgatgatgatgatattgtgttgataatgaataaattgatgggttgatgaagccatttgaattttttttgattatattcaatcggtttagagattttagtacaactaagatgtcatttttgttttttaaggtctaattaaatttatctcttttctggtatggttattcgattctccaataatataagtttcaattttcaagttttgaaaaacaaacaaacatagcttttagtttttttatacttcttcaacgtatgaatcaaatatgcatatggaacatcaaaatcaaatatgataactccatataacatattcttaagaatcttcaatgactttaacctcaccagaatcagcacctggtgatttttaactcttttcacttttgttttttaatgactcttctaaaaagatgttcgtaatacaaaaaaattagcttccaaaacttataaaagctatatagatcttactttaaaaaattaacaaatgcattgagctcttaatcactttctaatgaattcttttgttctacatatatcatgaatcatgacaaataacattcaatacctacatacaacttaacaaaattacattttttaataaaaaaagcccgcgatttggttcgggtttcgccctagtactaactagagaagaaagagattttcgaagaaaaaatatggaacatgtgaaaagtttagaaggtatgacacatattgcttaaacaaaatcataagaggatggaaagagacactgtaagaaaaaatgaaacaaataaaacgagtgcttgcaaaaagatagggagagtgatagctctttgtaaaaaaattgtgaagacagaaattcatatacatattgaaaagaatgtgagaaaatatgagttgttaaagtaaagtatagataagcttatgaatatacttctatataatatcttatttttagacgagctatactaactaatgcagcgaagataaacaaaaaagaatagtaaatttacggatttcaaaatgagaaagtcgtcgaagttattttccataaaacaatttatttcatacataaaaagacgtcgtgatcctaaatatctaaagctaaagagagagtcatgagccaaaaaaatgttcttttgataaatgttgtaaacctaaaagttgtattaaagttatttttagttttgtatttaaattgtaactattgtcatggtaattttaaaattcaaagagtttataatattaacaacaagtagacatataaaaacatatcttttaaaaaatttctataataattttattcacacaaaaaaatattaaaaagttttacaaatagacccatgcgtagcgtggattcataacctaggatttagaacgactaatcgggagttgccacataaataattaacatatttagtatctaattaattaacatttttgaaaacaaccaatcgggagctgccacatcaataattaacatatttagcatctaattaattaacatttttgaaaatagcaattactttatattttaaaatgtaaaaacaaaggaactaacaaatattaaatttaaacttataaaataggaagctatataattataattatgtaataataaactcaaacccttataggattttatacaactaatccaacatttttttaatataacttaaagaaacgtaacaaggacgtggtttgatggtggtgtttttaactgtatcaatttgaatcaagttctcgaagatatgctcgtggcaactaccatgagaattccactttttcggtcatgtgacaaccacacaaatttccgagtttcacgagttcaaaatcggtgtttcaactcgtaacttagccttgaacgcataaaagcgaactgaatgaattagagttgtaatgttgtatttatttttgtagattgttttaatccgcttcttgctaatctctgtatttctgtcaaaaatcaaaaataatataaaatctaattgtctaccaaaaaaaaaatcattcatagtccatgagtagaatcaaaacaagatagattcaaactttatcaagatagataaataagctaagaaatgaaatagttcctcaaaactaaatttagtgtcaccaagaggcaagatcaaacttttcaaataagggaaagaagagaattgcaacgtgattaattgatgaggtcatagtaaaagtcaaaaatctgtgtgactcaaaacgggtaaaaacaataattgggatgtagttgataactctaaaaaaaaagggacaaaaatgagatttgcataaagtagagatacaaaattgagaagaaaaaaaaatcctcttcactaaaaaaaaaaaaacttccgttatcgatctctatctctctcttcccccacaagggtggcgattcgaggagtttccatggtggaacagaaaccctagagcctttatgctgccactaattatcactcttcactattgaattggggatggactcagagaaaatcctcaatccaagacttgtttcgattaatagcaccagccgcaaaggtatgtccgttgagttgccgcagaaaccgccgccaccgccgtcgttgttagaccggtttaaagctttgcttaatcagcgtgaagatgagttcggtggtggtgaagaggttttgcctccgagtatggatgagattgttcagctttatgaggttgttttgggtgagcttactttcaattctaagcctattatcactgatctcactattatcgctggtgaacaacgggaacatggtgaaggaatcgctaatgctatttgcactcgaatccttgaggtttgctttcttcttatttgtttccactttctagccttattgtatagtatgtaagtgtagaagtgggaaaaaaattaggtttttgattgtcagagattagtgtttggtttgtggtttagtgaaatggctgcttctgagttacctgtgggtgtatatatgcaggctcctgttgagcaaaagttgccatctctgtatcttttagacagcattgttaagaacattgggcgggattatggtcgctatttctcatcccgtctacccgaggtgagcagtctacaagaagatgtttacttaaatgatttgaatagggctgaagcatacccatgagctgttttgatcctattctgctttaggtcttctgccttgcatataggcaagcacatccgagtttacatccgtcaatgcgtcacctgtttgggacttggtcgagtgtttttccaccacctgtactacgcaagattgatatgcaattgcaactttcatctgcagcaaaccaatcttccgtaggggcttctgagcctagtcaaccaacgagaggtatacatgttaatccaaaatatcttcgcaggctggagccctcagccgccgaaaatgtaagcctttctctttgtcattatgaacagagatgacattctttttttaggtgcatctgcaaccttgaagctatggtgtgttaattttatataagtgtactaagtaaaacgggtattagattagtttggcctcatagtggtcttatccattgtatttctttaaagttttgttagttagacgagatagatgtttacattcttcaagtaatcaatcttgactggaagggagttgttgttatggcctctctcagttatacatgatgagtaggtcactgggactctggtacattagaaatgatcttgttagcacatgtagagggtttttttttggttatagtacagtagatcactgtttatgcatcatgtgtcgtttggaactgtttttatatgttttttttcaaagagtgactatacctgagatgcatatttccttaattgctcttgcttgacatgcagaatttgagaggaattaattccagtgcaagagtttatggccaaaattcactcggtgggtataatgatttcgaagatcagttagagagcccatcttcactgtctagtacaccagatggttttaccaggaggtctaatgatggagctaatccttctaatcaagcttttaactatggaatgggtcgagctactagcagagatgatgaacatatggaatggcgaagaaaggaaaacttaggccaaggaaatgatcacgaaagacctagagcgttgatagatgcatatggagttgacaccagcaaacacgtaacgatcaataaaccaattcgcgatatgaatggcatgcacagtaagatggttacaccatggcagaacactgaggaagaagagtttgattgggaagatatgagccctaccctagatcgtagcagagctggtgaatttttgcgatcatctgtaccagcattaggaagtgtaagggcaagacccagagtaggaaacacaagtgattttcatttagattctgacattaagaatggtgtaagtcatcagctacgagaaaattggagtttgtcacaaaattatccacatacatccaaccgtgttgatacaagagcaggaaaagacttgaaagtattggcttcatctgtagggttagtttcatcaaacagtgaattcggggctcctccatttgatagcattcaagatgttaactcacgttttggccgggctcttcctgatgggacatggccccatttgagtgctagaggacccaactctctccctgtaccttctgctcatttgcatcatttggcaaatcccggtaatgcgatgtcaaatcgcttgcaaggtaagcctttatataggcccgaaaaccaggtctctcagagtcatcttaatgatatgactcaacagaatcagatgctagttaattatttgccatcctcatctgctatggctccaaggccaatgcaatcgttgttaacccacgtaagtcatgggtaccctccacatgggtcaaccattagaccatctttatcaatccaaggtggggaagccatgcatcctctttcttcaggagttttatctcagataggagcctctaatcaaccaccaggtggcgcattctctggtctgattggctctctcatggctcaaggtttgatctcattgaacaatcagcctgctggtcaggtaattattcaaatcatgtccttgagagtcggtttgttcttagttattgctttatcttgaattgttggtttatatattcagggaccattggggttggagtttgatgcagacatgctcaagatacgtaatgagtctgcaatcagtgctttatatggggatctcccgaggcaatgcacaacctgtggtctacgcttcaagtgccaagaagagcacagtaagcacatggattggcatgtaaccaagaacaggatgtccaagaaccataagcagaacccttctcggaaatggtttgtaagtgctagcatgtggctcagtggtgcagaagcacttggagctgaagcagtaccagggttcttgcccacggagccaacaacagaaaagaaggatgacgaagatatggcagttcctgcagatgaagaccaaacttcatgtgcattatgtggtgagccatttgaagacttttatagtgatgaaaccgaggaatggatgtacaaaggtgcggtatacatgaatgctcctgaagaatcaacaacagatatggacaagtctcagttaggtcctatagtgcatgcaaagtgcaggccagagtccaatggggtaagccattccatgcattttcattagcttcatttgtgtctagttgaatccattttcattttcgctgctagacatttatccagtgacgacctcttgatttcccgatcatggctttttcagggtgatatggaagagggtagtcagaggaaaaagatgcggagttagatcccttagaccgaattttaggtctttttcttgactacatttaagttacattcttatttcttcatcatctatatgcacttagtcacagaataccaccaatgaagagaaatgatggagagagtcttctttctcctaaaactgtaccattgaaaaaaagaggtttacacccacatatattatcattctttatgcctctaaattcctgttgtgccttaggacatggatatcgtgtaactgttctgcattctctgctacacctaacctggggtgcttgtagtagtaaaatcagatgtcgcaacagtagtttccccatgtaaatggaatacaatgtctctgtttcggattgtctttttctttttcatctttagatattgcagggaaagcccgagaagactgatattcgaatgtgaacagatttcttatgatgaatggatctcatagatgctgttgctaagagaaccagtttcaggtttcttctttagagctttccctgtctgagttttacctttctatgttaggctgttagctaaaaatgttagttaacataactctctttaagcgtatttgttctcttgactttgtctataatgaaacaagttttacttttcttctatctgaaccttttgcttttgaaatttccactacttgtatcttcatacctacatgatacagagccggatttatgtcgaagtagattgaacgatagttaaagctttcgaacttacttggctttttgctcgatcaaactagagttttttcatgactgttacatttgaaatatggaattataaagatttaaaggttatgatttagttctggtagtaccttataggactgcagagcaaactcagttcaaatctggctttgtctcaaccgttagtctctaaacaagagtatgtgatgatcaatagatgtaatggctggagtaaaattcatgtttgttatatacattgtgaaaatagtctattatagtatgaatataagaaaacagcttgcaatatgcaatatgaactaagctagaacaaaagatcaggttaagaacacacatcattgcccttttattttgcctttgttagaaaattggaccgttggttgaatgggataagagagagctaacagaaactagtagtgtactaataacaaagattttaactccatatctgtcaagtgcaacaaaagggcttacaatacaaaacaacaaagaaactgacaacttgggtcggagaacgcaaaaaggggaaacccaaaaggtgttcaaaaaactgtcaacgaaacgcaaaatagacaatttaaaaccgtggtttccagcagaagtcaatacccgaaccactttaccttttttcatcagcttgagatgaaattaaacgcaaaaggtgcgttcttgacttcctttggatttcaaaaaacacaaaatgagaaaccataaccgctcttaatccttccttttctcttattcttacttcttctgcataaggaaaaaacacttgttacttgctccacaagaatcccattcggttaagatcttagttgtggaatcatacctgaaaaaaaactacgctcctcctccaacatcacaagaaacagcagctttaatcctctccaccgtacatttgatcagactattaaccgtagccaccgagccaagtgagagtttagctgtaggaacagagtcaacaagaatctgaaacgcaacggttaaaagcgaaccaccacaactcccagaagaagtagtagaaaccatttcctgatgctgattcccatctcctcctccaaccgaaccatccggtaaaatagcaaaaccagacggcaacaacgccacgtaatcaggatctccaccgcttagaaccacattcatcgccactatatccactggcgcgtaaatcacatacgatcctgatgcatctgtacagctctcttgtagaatcaacatgttgctctggctcgagtttccactctgtttacaacaacaacaaagtttcctcaatctgaaaacgataaaacaaagagaaaatatcgatagttaataatgtcaagtcttacattgactcggagcaaggagacacagtttccaggttcatgaccattggctatatgagccatttcctgaaccatacctccatttgacagaatatcccactgcatcaaagttcaaaacctaaattaacaaacctaaatctacaaatcgtgactcgcaaggttctaaccctattttctttgtttattcaatttggtctgaagtaataattttaaacttttgcattacctcttttcttgaattttcgtcacggaggaaatcaaaaacacgtttgggagcaactgggatccagaatgaagtagctgcactaagaacaatacccggaggtcttcctggatcatccatactcttgcgggtcatgacccgaacatcatcggatcctgttgtcgacattgttgtccaagcgtgtgcagtcgacgcgccaacaccactgcagaaactcataaccattctctcagctagcttcaacatactcttccttccttcaggactcgttatcactacatatattaattaccataaattataaggaccaaattagtaaaaattaaaactaacgttttcatttaatttagccccaacatatttgaattgatcagaatagcccctaccggaaagatcaccaggaatgttgctggccatggagctagcaagccgctcgcattgtcgttcgagtgtagccacccaacgtttcgcaccgaaagctaaaccggactgaaccaacggtttatacatgttgtgaactgatctatcatctacctccatatgctctatccatgtaacctttgaacagagtaatcatcatcacacaatcagtttcataaaatttaaatttctaccataaactttataaatactcaatttaaaccctatataccttagaataaccattaggcaattcttgaatcagacaacctgaaggccttcttctagttcttaagattggagtacttggtctaaggctgtccaaagagacatcaaccacagcccaagagccgtcactgtgttgtttgcagtatctcacaaagtagttctcacgcgttgggactaggggtgatggaacttgaaactcagctgtcatcttcacatacccaaaataacattcagaaaccgattatcatagtattcaatgtataggtttcttgagaagcaagtaattaaacacatgtacataccacttgtaaagcaccgttgtagttcccagcaactccagttgaaagaacttcaagtgtcaaggctcttgacacaatcccagagaaaacacaagaccattgattcttgaacccacatcaaaagattaaaactttagttagtttattcaatcatttttagcccttaagttacttgaagaacaagtaattaccacatccatgagaatctcaacgagattgatgtgattcattataacaactgcagattgtcttgacgcctctgatcttaatcctaatggctttggtccaattcctctcggaaacgttctgaaatactcttcttcgttgagaatctcgactgaattatcggttgaaagccataaaggatctccagtttgagccattctcacgagttcctccatagctgcaaccgctagctccacgattataggcttatcagtctcagaaggaatcgaaactgacctcaaaatgtcccctgttccatacatttctcctacaaagcctgtctggttcccaaagtttccaacttcaagatcaagcgaacgagaaggcgcgtggatcgctagtggagcgaaagacgatcctaacggcttcccaacgtatttcgcagcaatagcagagatcctatcaatctgtagaatgaagaggtaacagatttagagttcaagttcatcaaacaaaagtaatatagacagatgtatgtatatacctcttcgcggagccgagcattttcgatcctgagatgttgttcgtcaaaagacatttctccaatagcagctggaccgccacagttagggcatgtagcattgcttagagcttctttgtatctattgttctctgctctgagcttgtcattgtctgactttagaatctggttctcatgcctctcactttgtgcctatatatattacacacaatgtattgtactgagaaatctttgactaatatgaaactagattacttaaaatattgatattggctttaagaagaatatatatactagttaatggttacaaaccttcatctgtgtgcgtttgttttggaaccaaaacttaacttgaagaggctctaaattgagatcacggctcaactcttttcgttgcttatcatctggatgaggacattccttaaagaatctgtaaaactccaaaaaactcaaaatataagagaatgttttcaatctgttgtgacatatatatgagctatgagttttcagtgtgtttttcttacgattcgagctcttgaatttggcgttgcgtgtggcgatggtaacgcttctttttgttgggacgttggctaggatcttgaagctcttcaccagaaggattctcagtagtgacttcggtacctgacttggtctcaaagtcatcttctcggctaccggtgattcccaagtcgttatcagaggtactctttggggtcatatcgaacatatgatggctctcaaacatgtttggatggtacattgttatggatgattgactatgatcactcagttagatattaataacgaaatggatttttggagttgtcaactttggtttccttcaaggcactgatcaatatattttcgtgatttgattttcttctccaagtatatcttccactgcccaaaatcaaaatcacaatcgaattagtaaaagattatatatgaaacgctcatatatgtatacagaatgaagaagaagaaaatcattatggaaatggaagaaaataattatattaagggaaagttatttctagctgttatgaaactatatattaaattaataattttatcattttcacaagtactaaaccattaattgttaggtttttgtttactctccattttttcggttggatatgtatatatttttgcatacaatttatagataaattcatctaatcataattatgtaactattaattaaaactcttaattacgtatgaaaactatctaagatgttatagtatagaaatttcagatataaataacataaaatatttatataatgtatacatccctaaaaaattataatgaaactaaagattaacgataatatttgttaaaaatgaggcacatatacatacaaattatgtatacgtacatatgtataaatatatatattacaaacgtaatatttacatatataacttttactttataacataacatataaactctataatcaatatgataatgacctaatatattaattttacaaataatgagatggaaatatgaggagagatttgaatatagacccaaaatgatatttttacttcaaagtttttttttttggaaagcgattttctttacgaaaacggataaattgttttagatttataatgacggccttacaaaaacaacaaatgagataagaaacaaacaaaaatgagatttgggtagtttttattcacacttaagatggatccatccatatgcacagtaacatatatgagagtatatctatctccaagtatgtgtacatataaacaaacaaacaaaaagaaaaatcaatcttgaaagtcacaagacttctcaaagcatcagatctatcggacagatctagtgtaggaagaagcgagagagagagagttatgatctttaagaaaccctagtttggtgtatggtcagaaatgatacagtaagaagaacacttaaataatataaatacttactcaattcgatctgaaactcaagaaagttttgaaaccctaaagatagatctctttgtagttattttttctttttttcccttttgttggttgaagttttggattcgagtttaatgatcttttctctctcttttgtcgactcaaaagctagtaagagaagagagagagagaaccagattcacaagcttctgatctctcaattgaatttattaaagaattaaattgaccttggtctttgtgcactaaagacgaaccgtttccagtaacaaaactaatgaaaaaggctaagtttaattagtttaatacaggatatatagggttgattaattaaaagcgattaaaaatagtatatagtatatagggttaattaaagcgttgacaataagtcaatggtcttttttttgtgacacaaccaccaagtagatttcgtcaaaccccttttgaaactgctaactccaagaaagtttttggtaacgctttatttatcttagatcataagtctccgcaaaaagacacaaaaaacattaaattaaattaaactaaaataatctagaaaaaaaaacaaatcataggcatcgagatcttgagaaccaaaaaacaccataaacaaaaaaatagaagatctaagagtctcaacaacatgcaatatggatccgatctataaacataacctaagatacatacacacaaatgcatatgcatacatatatgtgtagagagagaaagatcttttttgataatagagatcttacttttggagacacagtgaaaccctaattcacaatgatctttggtttatgcccatttttgcctttgaagaacagaagatctgagacaatgataaagagaagtaaaagggttggttgctccggaaaaaccgaccggttacccgagaaccggtgttattttgggataatctcaaaccggggaagagctagctaggtattaagaacaatggaagtttgttgttgaagaagaagaaggagaagaggacaagagaggaaggaaaagaacaggtggagttgcaataagaaatttaaaaggagttattgatgagcgcatagagagggtgcaatgcatttatgatgatctaaagctccattaatgctatagtgagagaaacttactcatttctttgtatatttatctctatagagtgatagaaagagtttcggtttatataagtcaaaaccaaaatcactgtttttcttttacctctataggttaaataaaaaacgtttaagcttgtaaagaataatcaaaaaaatttacatgcaagtgtttcgttggctacttggcttccacatatactaatgtgtataagaattcatattacaaccatttcgtacctcatctatgtcaacaacaacgcattagttaggttaacaaagatttagttacttgtcatattgcgtagttctcaaaatttagacctaagtgctagtgtactacaacatgtatatattcgtgcgtgtgcgtgtgtgtgtgtgtctaaattatgcatgaatacataaatgatttttattgttcaaatgctaattaagcgtttgatattattgtttttgtattaatgatagtagatttactcatatgcgagaactatatccaatatagaagcatggacgacgacatatcaataagagagagtttcttctattaattttcttagttattagctagctaggtcttccaactaagtatttataaccttttttctaataatcatcaattttaatggccctcgacttgatttcgagagaatatctaatatcttcatcattttctaatacgtatttattacagaaaatgacttttttttaatatgattttaaattatagtcaaaagaaaaagttactggatattacatatgaatgtaaaaacttttcagaatatatacaagaaattaagaattctagtcataatctcttcttgttgcaaaccaaagtactatgtcatcttcgtacttcgatgtgcctccactcttgagcgtgctaagccggtttttaatgtttttatcgaacgtcttgacaagcgttgcagttggtaaaggttgtttcccttgcctcctcctattattgcagaaaatagcttttaatatactaaatagatcgagtttaaattaaagaaaaatatacatgtcagaaactattgatctacagttttttaaaaagaggaaatatatgccacataacaagatgaatgtataatttgacattctactcaagtcagagctaaattgtacctgttactagtcatagccgcataaatattgatctcgtgatatgcaaatggaaaaattctgatgagatcaattttgttaacgatcagttgatctagaaaaatataggtgagatggatttagttggctagattatgtaatatatgatacaaatatcttgcgtcttgtttttttttttatcaaatgcactttttaagttatggatatgcatgtttccacattttcaaatgttttgctttttgcatatgctgtataataacaaacataataccgccgtacagcatctaagtcgtggaggatacaaattgcatcggcacgacggcacaaaagcattttatttggctagtatatatggttgttaagcaggaaactcaagactaatgaaacgaggaatacaatatgatcctatttgtattatgtgtgttgagaaggaagagacagtaaaactttatgtcttgcaaagttggactatatgatcatgatcaatatcactccacaaggtttctttccaatgacatcaattaattcaactttggtttctttttggaatcaacattaaaatgatgattcagatcgatgaatatagttttcatgagtttggagttttttttttttttttgataatttgcaaggatcatgagccaaattaggggtgtgcataatatctaaacccgaacatagcgcccggaaacgcatacccaaacgtacccacaatttaaatacatagtaattatataataatatatatttctaataacataagtgttcaaatattcagattatcagatattttaatattttttggatatttaattaatctattttttgagtaaatttggatagaaatattcaaagcttttagacaatttgcatattttggaatagtttgaataaatttagttataaaatttttgattttggaaatctacagtaatgcgaatctaaatctgaaatataaaaatacccgaatatatacaatatttttaaatttaaaaatccaaaatatctgattcgaaccctaacccaaactcccacctctgccaaacattgaattttttttttttcttctggccatctattatcatatgtcatatgttctagactaactatgatatagtttatttatacgaaaattttgttccattattaaacaaacaaaaaaaactgatgggatacgtcaaattcaaacggcagacattgtgagtatgtgagataaacgacagtagttcaacatgagttttagatgaaaacgtcagaatatgcaaatttagagcggtaacttaacgaatgtgccaaaggtaattaagtaaattaaagaagatgaaacgcttggagcaatgcggcaacgtcaccttcaaataatttagctagtgggaaagagtgctactgttacctaccaactaactcatttattgactctatatatatatttttttttcttataaatttttcttttcttataattatttccttatttcaaaatttcaaattctcagacattgcgtaaagttacagacagattttgtttttctctttcaatgagaaaaataactttcagaaatattattaacttatatttcattaaaaaaacacatttgtaaaaagtaaaaaacataactatgtaattttatgacagttgttttttaatatgaaaaggtaacctatgtcttcaagtctatagttctcctatggtttttgttattaacaaatgagtggaacaatataaactataaacttcaaagtcaatgtataaaagagactacaaattaaaatgggggtaaaaaaaatgaaaagccatatagtgagtgatatatacacatgcatgggaccgagtcatttaatttatttaggaacatttcagtttatgttttgatttatttggccccacattttccaagttgaatttttgaatttgttttcatttgaacttgtattttgtttaatgtagattgttgatagattccatgcacttttcttctcattaattttcaaagtgatttttggagaaaaaatgctatatttataagagttattactagtaaactatagttcaattaacaaaccttttggcaaataacagagttttaagatatgtgtaataagactattaaataaaagttcaaaaactttcataatcctactaattttctctttaagatatggtgaagtaatgtgccgtagagggactcaatttctagatattttgttatcttctggaaatttagctattataacaaaatttgtgagatcatgcaaatctaactccattgccaagtgaattgctcaaagcctcaaagtgttactcgagatgacgtttcagtcttttgtcgctttggagatattgtttgtcttcacaactagtgcgagaataatcaacatgcaaatttacgttctttttattttttttaataatatttccttgctatgttttgagttttgactttcttcccaaataacacaaaagataattccactcaaattcaccatcatttcatacaaattttcttacttttttctttccctatttctaagtttacattaaaataaatcaaacgccaaacactacacgatgtctacatatgtgaaaaaaaatcccaaaatgaatcagcagaaaatgcaaacaaaatccccttaagtatgcacaaagatgaccaaacttttgattttttttttctttcacctattatatgttctagattaatcgtgatacagttgatttatacgaagatttggataatacagatgatcttgaagattttggagatgatgatgatgaagaagatttctttcttctactgcttttcttcttgttatttttcggtaaatttatcggagtaactggaggtatatctcgtagtgtatctgatattcctcgttgactcgatccttgatcaaaatctatatttacaaaaagaacataatgtgattagtaaattttgactaaaagcctaaaactgtagtaaaaaagacattaggtgaacaaaatgttttgatttaagaaaataaaagggtgaataaacctcaaatctttttggtagaatgaataaacttcaatataccaaattgggtcctaattttcaaagattaaaaacaattcataaatcataacttaaagtttttcccatcttgcaaatttcattctgaaaccttcgtaaaaagttataatattttggtgcttatttcaataaagttcatttttggttttaagttaaatatatattaccaaattccatctcttatctgcaatgatgatatacaaatcttctatttattcaatctatatataaaatttggataacccatctatatttgtttacctattcaaattgtaatttgaaagtaagtggatggttaatcacatcaattttaaagaaaaaaaaccaaggaaatgaaaaagttaaaaacaaataaataacttaccagtggaagaagaagaagtgaagaaagaagtagaaggtcttgcattactgaaagatgatggtcttggagataaaagctcagccccgaccttaaactcactcatcttcacaagaaatacaaatattcactgattagctatatgaattttacttcttttttaggttttacttgttagaaactagaattttcacatataggccgaaaaggcactaaagagcttacccaaccaggagcactaccagatgaaccctcccagccaatatgagccacatgttttacatctgttggaaacccaatttctatttcatctctctctttctcaacggctgaaacataagataatattcttaaaagccaaacaattacatgagaacactctacaaatatgtgatagacatttggtataagtactcaaatattcttggtacacatcaaaaacataatgtagaagcaaatatcaaaagatatatgcactaaatgactatatatatatatatatatatatgttgaaagtttattagcaagaataatgcagtagtaaaatcgtaaaatcataaaatgtctattaaatagcatgaaaaacccctattatacatgaatatcacaataatttgtctaaaccacttttgaaaccacgctcatttacgattttatcatcgtgtcattttgcaaattaataaatcttcactgtatccctatttagcaattttcatcaaatataggtaaacaattaatatattatatgaagagagaaaatggtaaagaaagtatattaccaaatatttgagagatacatttgaagcctttatagatgcccttcattttcattgacatggtgaagaagatcacaaaacctccaaactataatgctgaatttgtcttcgattatccttcgtaagactcgattacctgaaaactatgtgtcctttctattgccaagattgaagaagccaaacaacaatctcctctctccggatgctacttcaatgttctatgttttgtttaccaaaagttctggtttcagtatttagtattttactaatcaacccacaatatatatacaaaaggaaactagtagcaaatgatcataaagatataatgcatgtgatagatgaataatgtttctcctatggaacaagattggaatttattcgtttgataaaagatctaattaagcttcaaaatttaactttataaaagcacataatgtgaaaatattttaagttcaagattggtatacatgaccattatcatatgattttgagatttttgacattataaacccatgaaattgaattattgatgatatatatcattaagaaacttaattacgataaagtttacctgtaattctataaactcgttggaaaaagaatgatataaacaagaatagcagaatagagaaacagcctctcctttgattctatgcttctttcatcttttggagaagcctctcttgataaatcacaaagcatattatgtacaaaaggaatctcaattaacaaaacataatttcgtgaatttctcacgaaagtatgaaaaaaaaagagtttcaaaagatcgaagatggtgaaggccaagagaagaagaagacgaagaagaagacgaagaagaagacgaagaagaagacgaagaagaagacgaagaagaagacgaagaagaagacgaagaagagggagactaagtcaggcttaaggtaagagataagtaagtggagcaccatgaaatggcatctacacatatatatacttaaatttttaaaaactagaaaggaatatttcaggatggaatataatcactaatcaatgattagtttgtctatatatttgacacatatttagtaagaggagctgataatgatatatcaccagctataaattgatgtggatataattaaccagcaactattttagtttcataagaaattaacctcaagtgtttaagattttattatctggcgttggggattaatctagggtttattatagaccaaatattatatgaagctagagacaactgtacaagtttttaatgcatgcatattcaaatatacaaatcttatatttcatcatatttgttgaactcacgtttgtctaattgtctttctagctttcttgctggtataaatctcctaactggaatatgtattccagagtgaaattttcgattatgtaagttaataaatagattaatattcatatacattaacaaaaattctgatctgtcaagaaagcaaagaattttgaatgttgtgcgaagtgagagtcgctattaagaccacgttgacttgcataacactcaagtctttataagccaattagcacggtttacatatttgagatcgtggagatcacaagtaagaagatgaacgaggctaggcaattgtcaacaatgcagatcacaataagcgtgaaatagtgcaatttgatatcgatgtttctagccatgtaccgactagtccgaagggggactgaatataccactagtggtcgaggtggtccttaagaaacacaaggacatggaccatcatatgagttgaaatcaggagtcaaaccaaaccacaaattaataactacaatcaaaagaaatagtgttttagccacacaaaaacaagcaaaaaaaaaagcaaaataacatgatccgagtaacataattgcccttctcagttccactccaccaccaaataacataacccgagtaaaatttgtatccaaaaaaacaagatcaccatgagaatatctttaaaaggactagccagtgaagcgaatgaagtctcctaagcaatcatagaaatgattgatattgattttctctctcccagcatagatagcttctgcagatccaccgttttctccttgcgcagccatttctattagcatgtaaatcttcttgattggcatctgcgcgagaaagtaaaaaaccgttgttaagacaaacaaacaaacaaaacaatttcacggtttttgtcaatttccgcccggagaggacgaaaacttacgtcattgagagcctctgcagctgaatcaacatcatcctctgagaagaggttaagctgatttagcacctgaagcaaacgaaaaaaaaacaactgagaatttaaccagctcaagcattggattgttgggcaatgttagaaaagacacagtattgtcttggttaagcaaattctaatcatgccacatcgaacaactaaaaggaaaaaagagagtggatggtggagtttacaaagagaggagctggaaaaacaaattcgaaagtccatatatgaagaagataactcatttaccttctttgcgtcctctttttgcagtgtcggaacagagtgagtgacagagaagcaatcagagataccaacagactctaagaaggttacttcacttgttgtcccaaagacgagaagtttcttcccctgtgaacaaagattttaccaatttaaagatgttcaactgtaagaaattaacttatgatgatcaagcatatataaatatggataagaaaataacaaaacggtaatggaagcaccttaggaggaagtcgtttgagaaggaccatcagcgtctgtgaaattatgtttgaaaagcgaggaccgattgctatgaattccaacaatctgtaaatatcagaaatttaagtactttccagaagaaactacaaacgtatgctataagatattgagccaaggtctgaaacgtagaataaaaatagcaggtaataacctttcaatatcgtcaaggataatgatgctcattggagatttatatgcatcctcaaagacctggtctcattcacaccaaaaccaattgtcagtggatagaacagaataacaagaagtagaatgtttccagaggacagaccttgacaatgtgagcacattttgtgctctcagaaagaccaatcatagtttccgcagaaacctacaaaataagaaatcaatatcacacaaagagtaaaagatggtacggactaaatatactgtacaaagaaagatagacacttactatcttaacatatgggaagtcactatcgataccaattgttgctgctaaagcagttttcccactgtccagacaaaaaagttaaaacaatcagcaacaggttataaaacagtaagccaaaataatgtggctataactacggaagataccttccactgggcccctccagaaggcaagtgactagaggacttctagtactaactttaacttgctcgactagaagcatagctcttttgtaaatgtgattatgccgatgaccacaatctaccatcccattgagtctacatacatgtcagaaatgtaaaaactaaggcactggcaaataaaaatccaaaagtaatgcaatacatgcatgcgaaattgtcgctggaaatacaattggatcagacggaaaacaaaagaaaatatgtatgagtagtagagtactgcgttttcagaccatgactcacggaaaagaagagaattaagtttggctaaatcagcatatcaatgctaaaggcccattcgatcaagaactatcccaattcgtcaaaccaccacacacttattaaagaaaattacctgcagcgctctaggtcatctgtggaggctccaaatgcaggttgaacttcatagatagcgtggagaaaatcctccatagtgatcttgatattctcttcttccacaggctttgtaagatcatccatgcttagttgtctgtttaatgcatatgatgtagcacttttaacaacaccttcaagctctgcaccactgtaattttttgttcgagcagctgccagacaatattgatatatcacgtcagagaaacatttatgctagcaactaatccaaagcttaagactgaatttcttaggtcttcctaatacaaattactagacgatattcaaaagagtacatctgtcatgtagtgaggtggtgatatttggaattacagaacaggtctaccaaacattccatggtttaaacaattataatctatgaagacataccaagctcttggagattgatatcagtcccaaggaaagaattttccttcatcttatttgtatgaatctgaagaatttgtagacgcccagcttcatcaggaaggcttatctcaacctgaacctccaatcttccaggcctatagtccaagaaaataaaagtctaaattcgtatgtactacaaccattccaaaatttcatgtaagagcatatacgctttggatggaatcttttcaaatgacctaagataaaacgcaacttcaaaaccttccgtactgcttctggtgtaactagagtataaaagaaagggctgctatatattagcacaatgatagagataccttaaaagagcttcatcaagcaaatcctttctgtttgtcattccaatcagcaaaacattgtttaaggcctccacaccatctatctataaaaaaaggtgttagtcacgtccgtgaaaactccgaataaactgataatagcttgatctttgactgacctttgtcaaaagctggtttacaatactatcatggacacctgtgccatctctggttgaacctcttgactgaaaatcacaaagcatacaatcgttaatttattgtttaaactcataaccactagatcacttgaaagtatacccaaaatccagagaaaaatacagtcacaacacagagtagcaagatttcttacccagagttaatgggactggtggtcaaaactaaaagcatatttataacttcaaataagcaaaatcatcaaagataagaaaagataaagttgtgtaccttgcaaatagcatcaatctcatcaaaaataatgacatgcaactcactagcatcacctgagaaaataagaatgcccaattagtatatgcactggaaaaagaaaacacaaaagcacagatcagaaagaacaatgtttccttaccaagggtcctctggtcttgctcagcatcagcaaataagtctcttacattcttttctgtctcaccaacaaacttgctcagcacctcaggcccattaacgatctatataatgccagcaaaagaacaaaggaagcattaaacatgtggatttcaggaataaaaggcagtgaatgaaacattaaaatgtcgtaaactattgatgcaaataattaaaataggatctgcggctgccaatgtatgaaggaaatagtgagataattaaacagtcaatagcatgttctcacagaaggtgtacatccaaccagggtaacaaatcatgaagtgataatatatttaggtacatgcaagtgcaatcctgggtaacaaacttacaaaaaacatacaaatgaaattaaggactacaagcaagtaagttatcataattcttcttgatagactattatgaaaatcagaaatacctttggatcctttccattaagcatctttccaatttgccgtgccataagggttttgccagtaccaggaggtccaaaaagaagcatccctttaacatgctttattcccagtctgcaagatcaacaaagataaacttagaaggaatatatatctacaaatacagtctaacacttgcttgaagaatgagccagaaacctgctggtgacatgaggaggaaatacacgagaagcaaaagctcttctaaatatatcagcaaactctgcaccaagaccacctattcccagcgactcaaggttaaattccttatgtttgaatatattgctgctagcagcttcccgttggttgacaatctgcataagaacatacaagtttaaaatgaatacaagctagcaatctacatctgtttccataaaagagaaagcaccaaatgtgatactatttcaaatgtaagattgaatcatcatttgataggaattcttagagtaactgattcaattacacagatatagaaaacttatcaaaatcagacctttatgccacttgcatttgatgcttcaaacacaatatacgtgtctttagagagcaaccctctttcaatgccgttcgtgtgatcctgaccctcaacatccgctcgattgaccgtaagaatgtaattagttccatgatactcaaatgtcgctttctggcctacagtcaagacctgcagcagtgtgaattggttcaataaattaggctactatgattttgtgaggatctaaaggccaaataaccatataagtgataccacatatgaaataaatgagtaaatataactgtaagcagaatattataagatttgcagaatggtcaaccaaatgcattcaataaaaaccaatggttcagcagaaaaataaggtaaatgacaagatccatgtacacattgctacaaatggaaactataccagctaatctgttttatttagaccttatctgtttagaaatcacagttctctcgttttgcctctcagatgcatgcttaaaccacagcacaagacatgtatatcttcagaaaccaaacatgtaacattggttcaataaattagactaatacgattttgtgaggatctaaaggccaaataaccatataagtgataccacataatcaagaaatacatgagtaaatatctgtaagcataatattacaggatttgcagaatggtcaccaaatgcattcactgaaaaccaatgcttcagcagaaaaataaggtaaatgacaagatccatgtacacattgctacaaatggaaactatataaaacagattagctcgtatagtttccatttcccatataaaacaaatggaaaccaatgcgtgccttatctgtttagaaaccacagtactctcattttgcctctcagatgcatgcttaaaccacagcacgagatgcatgtatctttgaaaaccaaacatctaacaataacagagacagcagaacaagaatatctctacctggttggtgtatttcctcttaagctgggtcgaaaggagagcagcatcaacctgtaaagtaatattgtacagagaagttgagttcaatcacaaagcctacaaatatctcaagaaacacatcatagacatcaaacaaacctgctcgcttttagttcctttcttcacaaattccaactccagcgtcagcatagccagatcaaaattttcaggaggaacaaatctgcaagaacaagacaatattcagaaaccaaaaacgtattcatgccagaaaattaatataaaaacaagctgtataatcacctgctaacagataccatatcaccagtcgaaactctagcgtgtcgcctttgaatagcattgagagcaatatttccatcacggatgcttccatgtccagtaatcaccagttaagttcacaaaaatcgaaataaatgacacaatgaacaagttcaacattgtcaccgaccaaaggagcctagatttctataatccatgaaaaccagaaaaacctaacttgtactacgatcatagatcaatcaatcattataagaaccattcataaggccgagattcaaattcgaagatcgattttggtaaatttagcagtaattagccatatcacataaacaatcaactcctaggatcgcatttcgcattgcaatgtaagaaatgaatcgtaaaatggaaataagaaaggatatcagagagaaagaatgaagctatcggcaacgttggcgaggaagagatcggaaccgggaacggagaattgacggagatcggaagaagagcagtaagcgaggttagtaaaagctagatctgcggacggagtattggtcacagtcatcgtcatgacttgcgatccgtaacgacccgccatggctggggtttcgatctcaggtttcttcgagtctttttgatttttgtaaccttaacgaataagaaaatatttgagggagaagcaataaacagaagactacgattgcttccttgattttaataagatcttttatttttcgagtcctgatcaatgttttggaaaccagaccaaacattccggttcgaccaatagccgtctgaattaaaccaaaaagcggtaaattaaatctggtcataccctctcggctcggtattagaatccggtttgcaacacaaatcataattcattttttttgttgttcttttcttatttttttttttttttttcagtctaaattttagaatacttgctcactgattattttgagcaagtcatgcatgagacacatcctcacaattcaatttgagttcggattaaccacatttatttatttttcaacaaatagttcaaaacttcaatcgatgatcaattatgtgaaactagaaggtcaacacataaaagctcaaaagatcttggactgtcacagagcaatgatagatgatggatgctaatgaatggaataaacacaatgagaaggaagatgaggcaaaacaaccttcacatagggagatttttaaattgaacaactagctcaagtaaacttataagtaatgttgtaaacatggaatgaataagtttgaaatttggtgcattcttagatatgagaaggtggttaaaagggtatggtgcaaagacatatccatccctagtatttaatagattgaaagaaggaatttttttttggttctagtttaatgagtgaaaatgaaaaaataaataaaaaggcaaatgaagatgaagatgaactcaaacttttgactctctaatgtaatcttataagcaaataaccaacttttctactgaaagttataagaaaatgaggcaaaagttttatttatattagggaatttaatgaaaaaaaccctcaactttggccagatccatttttaaaccctaaactatgtttttagtaaaacaaaccctgaactaaaacctgttaataaacttaaccccacagtaattaaacaacgtttagggttaagtttattaacaggttttagttcagggtttgttttactaaaaacatagtttagggtttaaaaatggatctggccaaagttgaggttttttttcattaaattccctttatattaattgaagccgcaagcatgagcttgacccgtttgtgctcatggatggctctgcttgtatctagttagaagccgaaacaactagttttcagtacgctatgcatgtaactcaaagaatttggtgtaagcaataagtgattctcattcttggtcgtgctacattgagggagatacaacaaccatgggaaacacttatgcctaagcctaacttttgatttgggaggaggcaaatgaactaatgcctaagcctaatattttgcacaactctactcgcgtggcacctcttatcatcttcaaattggtggatcgtgagcttcgcaacctaatcacttctcgacgacatcgcaagcgttggcagcggctaatgcttttatggattcgttaaacacacctaaatcttttctaattctattgtagccttgtttttattttttttgccttggttacttttctataggttgtacgttcttgtattttctgaactctcattgtaatgatattaacaaatttagcaaaaaaaaaaaaaaactaatgtcaaacaaggatcctcaaatgccaaatgtcaaattaagttagtacctttccatgtttacaaatttgaatttgaagatggtaaattagaagaaaaaatgaaattatgatcattttccttaatcaaaagattcaaaactatcatttaaaatttacttcttcattttttgctcttaaaagaaaaagtaaaaaattacaaaaagaggggaaaaaaatttagagagaaagtgaccagacacgacggcgtttttgcatcactttcaccgagattttttttctgcatcccggcgacgagactgtgactccaccaaaccctaaaatcaaaattgcattttttgttcgattttgattttgtggggattttggaattttccccgcactaagtcgtctcgttaaccccacttaacagtttctcactttgacactttctctctctctcaacgcacagtgctttctgtcgccttcaatcgcgactttttgtcacacttgccctcttttctccgatttttctataaatttagggttttgtttgctttcgttgacatgaatcagcaaaacccagaagaagaagtttctttggttaataatagcggtggtggaggaatcatcgaagctccagctatagtggaggagaaagaggaagaaggattacagcagaagcaggaagagactattgagtctaccgatccgattctcgtcgtcgttgaggagaaattgttagagaaatcagtagacggagagaaagaagacgataatagtagtagtagtaacatggagattgatcctgtgagtccggctacagttttctgtgttaagcttaagcagcccaattccaatttgcttcataagatgagtgttcctgaattgtgccgtaacttcaggtttgactctctctcccatcggaaaatctttaaatttcatcaattcctgtaaagttttctccttttctttgtgttagtgctgttgcgtggtgtggcaaattgaatgctattgcttgtgcttccgagacctgtgccaggattccaaggtatggtttttgttacttttctatgtcttgaatgtatgggcagtgatgaatttctcaattttcatctttctctgttctcatctcttgcagctccaaggcaaatacacctttttggataccaatacatatcttgatacctgagcgccctactgagtgtgcggtgtttaatgttgtggcaggtattttgatatcagttaattatttatgaactcggttgatctagtgggtgataaacgattatgatgcaattttttatatgtagactctcctcgtgattctgtccaatttatcgaatggtctcccacttcttgtcctcgtgcgttactcattgctaattttcatggacgtataactatctggacgcagcctactcaggtttgtgctcctgatcactgggatttacctttatatttcttctttgtcttctgtgtcaagatgttttatgacaccctcagatgattttttttttgtggattggttttgcagggttcggctaatttagtgcacgacgctacctcctggcagtgtgagcatgaatggcgtcaggacattgctgttgttacaaagtggctgacaggggcttccccagtatgtaatcttatgttttgcttatttgccattctatcaaatgcacagcatatttgtcccttaatgagttcgttaaattagtaatggagggcttgcatgtgagagtgggcactgggattactaaatcgtgagtaattgaactggaaatgtctctacgttttggaggaaatgagatggagaaaacacaacgtcctggaaatcccaactctctgtttgcaaaattactagactcctaaaagatcttccaatttgcgtttcttagatgcatttctttaatgatcggcatgaacacataaggaaatgagtaacagatagataataatgccattgcaaagaacatgttctgaaggacttaatatcatgttgtttctggccacctagtttgctgctctagttttatcctaggaaatttatcctctatgttttctttttattgataatcagtataggtggttgtcctccaagccaagttctggtacaaatgcaaagtcaactttcgaggagaaatttctctcgcagagctctgaaagctcaggttttcttctgcgtgcctcttgtgactcattttttgatgatatattcagaattatgcacttaattttaattatgtcagttcctttgacatccaaatatatgtgacaagatcaatacaacatgttctgacgttagtgcattttcctccactttatgtgacggttctgattctctaccatttgttgcagctcggtggcccaactttctctgtgtatgctctgttttctcatccggctctgttcaaattcattggtcccagtggccttctaaccagggaagcactgcaccaaagtggtttagtacaaagaaaggtcttttaggtgcagggccaagtggaattatggctgctgatgctattataacagacagtggtgccatgcatgtagcaggagttccaattgtaaacccttcaacaattgtagtatgggaggtgacccctggccctggaaatggactccaggcgactccaaaaatctctacaggcagtcgtgtgccaccatcccttagttcttcttcttggacaggttttgctcctttagctgcgtacttgtttagctggcaagaatacttaatatccgagataaagcaagggaagaagccctcagatcaagattccagtgatgctatatcgctaagttgctcaccggtttccaatttttctgcttatgtaagtccagaggctgcagctcagtctgcagcaaccacaacatggggatctggtgttaccgctgttgcttttgatccaactcgtggtggttcagtgatagcagttgttatagttgaaggtactgttctcatccttctcggaacctcatactgtttccatgattgaataaacattttcaggtttacgtttagtttttggtcaatcatttagaaatgctcatatattgaagagctgccagatgagaaaatgctaattttgtttgagtgatgaagcgcaacagcttcaatctattgtttaaaataaatgctaattgtttgtgtctgcagggcagtacatgtctccgtatgatccagatgaaggtccttcaatcacaggctggagagtacagcgctgggaatcaagtgttcaacctgttgtactgcatcagatatttggaaacccaacttcaaattttggaggacaggtccccacgcaaactgtctgggtatccagagtggatatgagcataccacctactaaagattttaagaatcatcaagtagctgcagcaggaccaagtgtggatgcaccaaaggagcctgattctggtgatgagaaggctaacaaggttgtatttgatccttttgatttgccaagtgatattcggacacttgcacggattgtctattctgctcatggtggtgaaattgcgattgcttttcttcgtggtggagttcatatcttttctggtccaactttttcacctgttgaaaactatcaaataaatgttggatctgcaattgctgcacccgcattttcaccaacaagctgttgttcggcttctgtatggcatgatgctgctaaggactgcgcaatgttgaaaatcatccgtgttcttcctcctgctcttccgcgtaaccaatcaaaggttgatcaatcaacatgggagcgggcgatcgctgagaggtatgtaatctctggtatatattttctagcttgtctgcttgcaaaggaacttatattgtgacttgagatatgaatctgcattctttcttaacagattctggtggagtcttttggtcggagttgattggtgggatgcagttggctgcacacagagtgctgcagaggatgggataggtatactttagtgctaagtttcttgatttaagtgttatttaatatctgcagttggatttttttgggtctttagttgtggaacaaccactggaattagttttgcttagaaatatgacagtttgtattttagtttgggaataagttctagtttttaaaggctgagtgtcattcaaagaaccttttctctgtttttctattttgcttttatactaaggtttgaatgatagaaactttgaatgatagtggttcaaatattatattgtattgtttgaataatatactgcttaaagcattggatgatgtatttctttttatgattacagtttcattgaacagcgtgattgctgtcatggatgctgattttcactcccttccttcaacacagcacagacaacaatatggccctgtatgtttttactcaacccgaatccaactcattatctttttcctttttaaatgtctgaactgtttgcgttgcggtaccgtttattatgtctttgcaaaatatttatatatatatatatatttttttttctggttttataatgtaaagcttctctattccatgagcatgcagaacctattttgtgttgttcttttatcggactataagatagtgtagctttctctaatttaaaaaaagaaagaaaaaaggaacaaacttcatctgactttagattatttgagtagccaatatacaatgcatctgattgactgattctaagacgctgaacaaaatcttggcagtctattgcccccttgagattcttcgtgttttttttgcttttttcctttttggttggttgcgctttttggtaaagaacttgtatttttatggtttacagaacctagataggatcaaatgtcggttacttgaaggaaccaatgctcaagaggttcgtgccatggttttagatatgcaagcaaggttgttgttggacatgcttggaaaaggtattgaatcagctcttgtgaatccttcggcgttggtttttgagccatggcgagtagatggggagacaataacaggcatcaatccggaggcaatggctgttgatcctgctcttgtttccagtattcaggtatcttgatgccttcaaatctgaggataaagttgtaggttttctttgatgaaagatgaaaattcaggctcaaaccctgggaacggttcatgcagtgttttcatttaaagagtagttgctctttgctgatatatcttagtttttacttttaataatcagccaacacatgctgtattagatttggttatttagcacagcttaagacattttagatcatattgtgacattgcatattctatcatggatctcatatcattgtatatgaaacagaccatatcactatccttttacaagtttggtttcctgttgcagatttttctgtactctaattccttttccgcttcatttacaggcttatgtggatgctgttcttgatcttgcttctcatttcatcacacgtttaaggcgttatgcgagtttttgtcggactcttgcaagccatgctgcttctgctggaactggcagtaatcgcaacaatgttaccagtcccacacaaaatgcatcatctcctgcaacacctcagggtcagtatactattgattttgtcatacctaatttactccagcatgacaacaagggctttgaatggtacatagcgacaaaaaatttcattcccttgtcattcggtgatgatacgaagcacttgtttggtcctagatttattgaatatgagatgagtttcttaagtctagatattcttcatctctgtgaactatagcgtattgtccagctcttttttccacgtagattatgggagatacaactggttatatttgttgttgggcttggcatctctcttgtaggggtgcaattgggggatatttcaactcttttatgtacagtttttcctgacaagtcactgtatcttgcagtaggtcaacctactactactactactactactgctacgacaaactccagcggaagctcacatgtgcaagcttggatgcagggggccatagcgaaaattagtagctcgaatgatggatccaactctactgcaagcccaatcagtggttcacctaccttcatgccaataagcatcaatacaggaacatttccaggaacacctgctgttcggctcattggggattgtcatttccttcatcggttatgccagctgttgctcttctgttttctccagcggtcttcacgatttccacagcgaaatgctgatgttagttcacaaaaacttcaaacgggggctaccagcaaattggaagaagtcaactctgctaaaccaacccctgccttgaacaggatagaggacgcccagggattccggggtgcccagttgggtactggagtgaaagggattgatgaaaattctgctcgtacaacaaagatgggttctgggaatgccggtcaaggatatacttatgaggaggttggcacctatattcctgtgtcctctttattttgatacaattatctgtggaacccttttgttgttacctcaagaatagaggcttaggcttaatctggtcaatatgggtaagaataatgggaacccttggtaggttggggaaaaatatgatagactttgtagattttgaaacgaagaaagcaatgccatctttgatggtacaataatctagaaaatttcttataatgactggatactttctgatcttccaggtgagagttcttttccatatactaatggatctctgcaagcgaacatctggtcttgcgcatcccttacctggctctcaggtaggtagtggaaacattcaagttcgactgcattatattgatggaaattacactgtgttacccgaggtggtagaagcggctcttggaccacatatgcaggtaatctgtgtttatagtaaagtagtgaaactattttttcaattgttcttgttagtgatatttggtcaagtacattatgaaataatatcttgtgatctatattctcataagataatttgttgtaaaaactgaattaacagaacatgcctcgcccaagaggagctgatgctgctggtcttctacttcgggagttagagcttcatccgccttccgaagaatggcatagaagaaatttatttggtggtcccgggtcagagcctgaggatatgatcttgacagacgatgtttccaagctgagtaattccttagatctgcctgatacaaacttttccggaatatgtgatggatacaacagagtccatagtctttggccaagaaaacgcaggatgtctgaaagagatgcagcttttggttcaaatacttctgtgggtttgggtgcatatcttgggatcatgggttctcgtagggatgttgtgaccgcgacatggaaaactggtcttgaaggagtttggtacaaggttggttacgctcatacatttcccttaacatttctttattgttgtaatgtgataaagaagtaaaaagttcttctgtcacaccttagtaacatgattgactttcttattgcagtgcataagatgcctaaggcagacatctgcatttgcttcaccaggtgccactaagcagccaaatccgaatgaacgagaaacctggtggacaagtcgttgggtttattgctgccccatgtgtggtggaacgtgggtccgtgttgtataggcgaacaaatgaacttcccatctactatattggtattggatcgaatagccagaaaatcagtgattttgaggagcaaagagtgcaaaccaaacacacttctgcaagtttattctgttacttctaatccttattcccggactggtgtgatctaacccctgtccaatatggaaatcttgaatggaactgggagggagacagtgtctgcaaagattcaagacacggtgtagtgaaacaggtcttggtgtatagcgatttattagacttatggtctatagagtttacttcttgtggaatgtaaaactctttcaggctgcaacatcattttttaaatttctttaaagggctgtaacctttaacttaagtggtgtagtaaagactctagaagtcatggtggtgatgatgtaagggcccattggtaaagaccgttatggactttgaccgtagaaattttggttgtagagaatttgactataaagattttaagtttaaaaactttggccatgattggtaactaaaaagtaaaaactttagaaactgttactattatttttaatatatatattttttagaattataaattatgcaaaattagtttttatggcagtatagtaacaaaataaattttattataaattttagaaaaatacaacataaaattaaatagatagatactctcaaatctcaataaataaaaaataaatttaatacatataaagatttgataggtttttggatggatgaactatcacttttttcatcaaaataagattatattaatgaatttaaattgtcaagataccattgttcactgagtcatattgtgatgccttattacaactttttgtaaaccataattgggtattcaaaaatatcaaagaacggaaataaaaaaataattattaattaattaaaatatttttgagataaattactcattgattgagaaatagtttttcaatcattgtggaggaaatgaaaagaaaaaaaacaaattttattttattgttttttcttaaaatctaaaaaatctcatttttgtgactttaaaaatttgaacgtgaattgaataaaaaagagcagctatacttttaaaaataaataaaatctttaaaatatgattgataaaattttggcttttaatactttaaattaaaactaaagtttttaaagtgtcttccaatcaaccccgtattatagagtgcggcggcttgcggcgacttgcggcggcttgcggcggaagttgctatgcggctcggtgggtttcgtcgcgcgacttggtggttaacggcggatctgttcggatctgctatggctaatcgtgactcaaggctaattagggttgtcggagccaccgtccctgttagtctcgcgatttggtttccactagtccggatcgatcttgactggtctcgggaagggtgcgttgttcatcggacgacggaagggggttacatcttgcattcatcgatttgctaggtaggggaatcggtggagggccgcggttagtcggagttttgacttattccgggaggtttgttgcaggtatggctcgtcattggaagcggatcggcgacgggaactgagtactcctgtcaaaggttgtttccggcgatgtagctgcaacgcagtggaccttgtactcaccggatctagtaggtgggagattttgctttccggtcggtcactcatttcagatctcggccatcaccggtgtttccgattcacttttccgttttgtatccatgaatctttgtatgttcgtgggccgaaacccatttgggaaattaatgaagaaaaaaaaaaaaaaaaaaaccgtattgtagatttttttttttcctcataagtgttgctctttatttatatcttaagtcgtaagaaatacaacagtgtaaccttccacttacaggccctgcacacattaaactgtaaccaacaaattcaacttaaaggcctaatattatgaaagctcaatctagaaactaaaccttttgaggaagtaaacattaaaacttccaacacagagccacatgtgatgctatgaactaaagtttaacacgttgagagatgaagtttatgttgtcgccgttcatcgtatggtaagcaacaaacggaaactccaaaaccaccggaaaccattagaacttcaaacacagaagtctatcggtttttaattggagaagctcactaaacttcaacatcaaaactgcaaagaaaatatcttcccaaagcaattgattccaaatctccgaagaacatcggtgaaacatttaaatcgatggagctttcagcaacacctataaacgaagagaaacaaactcgattccatagatcggttaaagaaatagccacaattgcataaattcaatccaaagtcacaaaaaaaaaaccttaacccctaactccaatttgttcttaaaaattgaaattgataaacttggaacacaaatcgagctctttaaacgcctgggattcaaggaattacgattccagtactcaaatagaattgcaaaagagtctaatcagaccgaaaataaggaaatcgagacaaagaaagcataattttgaaccaaaaacaatctggccaaaagctaaaagaaacaccagagctatatggtgaatttctagaacttagctagcccaccgctactgtagaagccaacggaagccagacacaagccaaccaccaccgtaaaagagaaacaagatggtgtcagaagagagccgatcaaacgttgtcgaaaagacaaacgttaacggacaagagccagacatctatgctgagaaagccataggattctgttcagaagccatcgtgaacgatcaacagatgctgaagtagcaatcgttatcagattaagaagcttcgatcgtttcctctctctaaaggatagagatgagagaagagagaggaaaagcaacaaaacaaaaaaaaaaaaatcacagtatttgtcttgtattatagagttcataaatcatgatggtgttaatttttatgcaagattgtgtttgtcatgaaaagtggactgttgactcgtgatgctgctaagctaatagaaaggtcaattttatactgccaataacggtactactttatttaactttcctctcatttttgtcaactactaattatagttacagctatttcataatttccttaactgaatcaaatcaattaaaaataggtataagaagtttatatgtacttgttatttacgtcgtgcatggagcatacatcgacatgttcatagccaacacaaaaataattattatcaaggttattgactttctcactagctcacttattattttacccgataacacgttatttaacatgatctcacgtcatatgtaacaattacgtgtgaaaaacaatttacttatttatgattttgtcaccacatgttacatgtatatcatcacgtcatatacacatttagcagattcatcattacatattataaaaagcaaagatttaattcaagcagataataattataagctagagtctaaagaaacaaacttcaaagccaagctgtgaataagtttttggttcttaattcttccattcatagaaaattatataaatctaaatgaaaagtggaagcttccttgctcattggttgaccaagggttcattattaatacttctacaccaagaggtctggggttcgagttttagatactgcgatttattaacaaatttacagattaatggaggcaagtgtgcatgagatctctaacaatgtacgattatagccgtttgaaaggattatacgcacagaagatcagtgaagctctccatcaaaagcatggagaaggaaaatgaggcgtcgtctgtcgtggatctaataagggtcaaaaggaattttccatggtataatcgtttatgtaacagttcttataatttgtaacaaataataaatctaatacagaaaaaaaaaaaaaaaaaaaacccaataaaaataaaagaaaaattgaaaaatgactaaatatagttagttaagaaaatcccgcatattattggtttatatcctcgcacacacatgcatgtgcacgtgcaacgtcttctcttctcttctcttccaccattgaaaacctatgcaccatctcctaaattgcaccactttaaattatcttcgaaaccaaaatctctctctcgtttgactttccctctctcccgtcgtttcaccggaaaaaaacaacagaaaaaaaaccgacgggagagaagaacaaacaataatggggaaaggaggacgtgagaagatatcatcaaacgaagaagaaagagaaggagtcatggctacagatttcttttggtcttacaccgatgagcctcatgcttcgaggagacgtcagattctgtcttgttaccctcagattagacaactctttggtcctgatccatgggctttcctcaaggttcttattctctaccatttttctcggatcttagatcgatatttccatttttctaggacgtctagttttgttctttgtcctctttttaaaaatgtgtttgatacataaacgaaggttgtcgaagaaacaaacgaatctgttattttcttacgtttagaaatttcggatttgtttttgatcctacaacattttgagtttgtgtaatatctcaagaaaaaagcatttgagtttgtgattcgtatgtgatcttgctaactccattaaccaattattagggtttgtgtttttttgaggtccgcaaatttgagttttaggagctgaaaaataaaactcatgttttagggtttctcacattttggagatgattccaagcaactgaattttatttcagttcgagttaggaattttttttattttttaataatttgtttagtagaatttttgtatttttgttttcaattatatttttttatcatatattttagttacaaatattatgtttcaaaagattctgcttatttggcataaaagtttctctatcgttagggctattagctaaaatttggttagattttgggttgatgaatgtcacatttcacccaaaatctttcaaaatattaaaatttgttttgatgttatctaaacccaaatgaataaccaattttgtatttgttgtctatacagatcacattagtagtaattcttcaactctcaacagctgcaatccttcacaactctggatggctcaagattctatccattgcttacttctttggatcattcctcaaccacaatctcttcttagcaatccatgagctaagtcacaaccttgccttttcaactcctgtctacaatcgttgtctcggtattttcgcaaatctcccaatcggtgtaccaatgtcagtaactttccaaaaataccatctcgagcatcatcggttccaaggagtagatggtattgacatggatgttcctacttacaccgaagctcatttagtaaccaatatctttgccaaaacaatttgggttttcttacaactcttcttttacgctcttcgtcctatcttcatcaaaccaaaaccacctggctactgggagttcatcaacttcttgattcagattgttttagatgtatcagttgttctcttcttcggatggagatctttcgcgtatctaatcttatcgacatttgttggaggcggtatgcatccaatggcgggacattttatctcggaacattatgtttttaacccgaatcaagagacttattcgtattacggtccattgaatctactaacatggagtgttggttaccataacgagcatcacgatttcccgaggataccgggaaataagctgcatttggtgaaggagattgcaggagagtattatgaaggattggagtcgtataagtcatggtcacaagtgatttatatgtatattatggatacaacagttggtccttatagcagaatgaagaggaagctctcaaagtctgactaatttttctttgtttcttacatcaaactcttcttttattctattttagtatttttgttttgagggttgattttttcaactttattggaggacaaatctgtgatcttaggttgcagattttatgatttctcacggaatttaaaccctatcatccaattcaggataacgttgacatgttccatttgatacatgttaatgctaaaagacagggcaatatattaagcttcttcaaaattgctatttttgtgaaaaaacagagcaacatcaaaaacagagcaataagttagtaagcttcttcaaaactgtgaattgctaaggaaggtaactatgcatcttgtgctctggaaaagcttctccattttctgccacaccaaactctgagtttctaaaagcttcttcgccttctcttgtaaactcgggtggcaccttatggtctcaccgtggatctgtcaacagataaaccgagttttgttaagagtcaagattcttgtaacctaaaggtgtctctgtaagaaactgattccttggttatactggaaatgaaatttacatttaccttcagaaatagtttcacaaccgcctgcataaactcaaagtcgtttttgcaagagacctcgttgatgaagtaatccagaagttgcccaatcaatataaactcaggtcttttgataagctcttcttcaacatcttcatctatgatttcaagcatccgaagctccatgtcgagagctgacggggataaactcttcatgtagttggtaaaatctaaaactgcaaaacatacatggagctaagaatcgtattgtacattgacgagaaaagctttgattaacctgtaaaacttaaacaaataccatcacttacagtgttttgaatcccatgaagacttgagatgttttgagaatggagattccaatgcatcaaagttcttcatgctattctggtcctttttattattttcctcattctccccatcagcctcagagtcatttgccttgaataatatatctccagacagcgagggaattgagggcaagaaaaaaggagccttttcaggtttctttggaggctctattggtttattgcgggcctatgaaacaacatcaaatataaattgtaactggaagacgcaacaaagaaacaaaccatcaataaaaagttgagaagaaaaagaatatgcataccttaataatatccaagttgatcaaactctgccattggctttttggcaatagagacagagtaacaagttctgggatctgcttttgggaaattgagaaactgctagcttgtagagcttcagaattttctaacacttgcctgtccatatcatcatcagcttcagaagatgtcaatgcagagactgaaggcaacttgacatttacgacatctttcccactagcataagattcaacacttggaagcccagagaacatggattggttaaccctgagaggtcacaagaggagagagtgaactcatcaaacaatcacagagaaattgtaatagtaaatgagagaactgaagattgatttgagaatttaccacaagtagaccccgttctgatcagagtgggcagttgccaaaacgtccatatttggtgataaagacaatgctgttattggcacatcgacatgcacaccatcaatctgcttagccaatatgacatcccatattctaagacttccatccatgctagatgagatgacccatttgccatcctcactaaagcacaaatccgttatacggtctgtatgacctctaaattcacgaaccatctttagtgtcacaacatcatataaacggataacaaaatcatccgccactgtagccaaaagacctaccaattgataagaaattagcaaagtcagagtcaatacggtggtaccctaggagaaaatgacggaaaatgatacatttgtgagatcgtacaagtgaaaatgtagggttagattaggaaaatttaccatttacacggtggtagacaattttaaccaacgaacatccgacatcccactgggactttaattcccgctttttgaaatcccaaacctgtattacacaaatgaaatattagagtctatttgactcataaactagagttaatgttgaaggtaaccatatcaactaagtaattaataacttaaagaaagaacaagaaaacattccaaacctttaagtccccatgatatcctgcactaatcatgagtgtgtttgtggagtcgcaagcaactccaataacttctccatcatgggcgtaccttcttttctctgacatatcgaagtaactaccccggctgattccagattggaggttgaatctctcaatccatccaccagctgttccgactactgcaaagtttccacaggcactgattgcacatgcctatcagacaagcaattttttaagagatcaacaaccactagagagaagaaaaagaccagtattgctaaaagaagatggttcctagatacaaagaccccctgaacatgctataaggaactgtaactaaactcattttttgtagaattggttattcaaggggggtcaataatccaaattccaagttctcacagtaatcaattcccacctataaggactaaagcacgtctacttttcttgttcagaagagtgtcagaagtaaatataatttcaattttgaaccttaattggtgttggattctcagggcatggtttgaggatatgctctccaagtacaaagttctgaagtctccatacatatgcttctgctgtatccatatggcaagtaacaacattgcaccaatcacgctccctaatttcagcttcaatttttggaaaaaaaataataacagtcagtaggatgtataactagacaataatataagttgtgggagatgcagttttctcgtcatcaacatgcaaattcataggacaacataaagtaagatgtaagcttcacttcacaaaatgtaatttctctatggggttcaaccaataaacgttttcactattgagagccaaccattttggacctaattactgctcaacacattttgtagaaatcaattggtttctactttttagtcttgtttgttcagacatcataatattaagaatgtgactgaaagaaaccaagcaacataattacatgaaaagtaaagatcaagttatatagatacgtaccgcaatcaaatgaaacaacaggcttcaatttcaactcttcctcctacatatagaggaaaaagaatataagcgaaaaagatataatttccaagcacacatattactacggacacataaaatatcaaaacacagtatacataaggtataacatttgttaaattgaatcagaaccacttgaagcatgctaactggccatggaaaacttgaataaaattaaaagaaatcctttggctataccttcagtcggagttttttggctcgcctagaaatgtgtctttgagaaagctctctactttgttgctcctgatgaagtaattaatgtaaattaaaaactgttatcgtcaatggacatcagatctttagtaacaatacagaccacaaattaagaaacaataactcaacatttaagagaacaatcagattcatgaaaaaatcaaacaaacaggtcggtgaaaaaatacccatcaaaataacagtaagatatggcgaatgaaagacggaataagaaaaactaaactttgcgtctaaacagtacatgatgaggaaaatgattgctaattaattaattaatatgacaaaaatgaactcaacaatcttttatgattatctgttcaatgcccaaggaagactaatttcctaacatttgtgattgtaaagtgacaaatgaatagtcaatgtctacaatatagctcaaaagttacagactatcaatatgctagttagttgtattaaatctcgatatagaattggttactaaatctgtatcgtatcttacctggatgacagagaacaggcggaaggcacgatcctggccagcagacaaaatgtgccgtccattagagtagaacctaccacaagtagaagtcagatatgattaagagaccctttattggcatgccctcgatatagccaccatgaagtaaatactcttattaagaaacacaaatattcatcactacacagatagtcaactggcagggatcataaatggaattactttaacaacgaatagggatcataaatgctacttacacaccaaaatgtataaagtctcacaataacgaaagaaaagctaaatggaagcaatcagataattcagtatgatgtggacgtcaagctaattacctgatacatagaggaggagcactatgcccagatcggaagcgtaataggcgaggatcaccatcatttgtgtcaaaaatccacatctacaggaacgaggcataaaacaaatattatatgtggcaaagtggatgcaaataggttcaacgggtaagaggaatcttagcttactttaagtgagttatctgctgatgcactcattagcaccggctcattggctaaaaagttcaatgagattatagaactgtcatgtgcatccctaatgactgactgaagcctttttttgttaagattccagatgcttatgacaccaaaggaacctccagacgcaagaaggggacgtccatctaacatgacaggataaacaacacatgttagaactggaaagtatcgaacttccattagctatagaacggttactaccaaaagttactagtaaaattacaacctacactaatggatctcttgagcctgaaacatgtatggacaattctaattcatgaaacaatgggtgcatagatggtaaagctatgtaatggaaaaataaatatttagctccacttaaagacaaatggacgaaattatttttggtcactacactcataggatatctatcagcaagaaaagattgataaactattatccgctacgaaattagatttaaaaggtaataaaaccaagaagcgctcaaagattttacaaatagaactacagggcttaggtgtttacctgtactgaaagacaaagcagtaacagcacctcgcgaggcatgttcaaatgttacgatctcttcgtccaattttatgttatgtacatggatctttccatcagcacaaccaattgcaacaacatccagggcaggggatgaaacacaactggtgacagatgaaccccaacccttaaactgatagagcatcttcttagtattaatattccatagctgcagcggaccctcttggctccctacaagaacctaccaatgtggttccaagtaagagaaacatgcaaagagttagaaaggcttgtcaacagaagacaccaggggaaaaaaaactgaaatcctgaaccaagtatgactcaccttgttgagataggtatctgggtgaacaatagaggtaggggtaaactttccagtaagctgaagatttccaattggagctagatgttcttcgattcctttgaatgcccatatgaacatatttccttccacgtcaagactaagcacatgttctccaaacaccagtagaagatcaactttagcaacatgtttgctccaagttgctacctatagatatacccacaagaattccaactataaacaaagtactcatagatataaaaaaagcagcaacttaactatagttacaatgagatatacctgatgagcacgcctaaagacagcgatttcattgccaaacgcaacaaatgtgtagtctcggtaagaagctaaagctctaattttctttggaagctgaggacctttaagataacacaaattagattataagaaaatttacactgcatagacaaaacccaattctaaatgcatgaatttgagtaagagaatgattgaaaggacaaaactttaggtttcagaagaaggaaaaacttactgattatgactagattgagcttggcacactgcaacaagagaaccaaattaacaacagaatcgaatgaataaagaacacgcaagtgaaactatgaagattgggagcgttacattataaatctggaaagctttgccgacgctgacggtgacgaaagtctcggtacccaatcgctggacggagaacggaaccgtactcgttatgtaacctattgctctaaacggttcgaaaattcccatctttcgagttcgaacaagaaattagggtttcctcggaaaaacgattttaggattatcaaatcaaagaaaggttttttaagagcttgagagagaaaacgcggcgcaggagcgatggaggagatacagcaaacaagacctttggggtttagggtttaacgaaatttctttgtccgaattttaattttattttccggtttaagtgtccgctcggtttatacaggttctttatttggtttggagaatgttaaatttggtttggtaaaattatggttcggttttggctaaaagtcattgaaatgtaaaaccaaaaccattttagtttaatatttaactaattgtcaatatcagtatcaattttaaaattatgatgacttttggtttaaatcttgtttaaatgtacaaagtctcggttaatgctcgattgcagtttggtctaaactctaaacaaatgatttccattcggtttgattctaagaaatttgagtttaatcacacaaaatcccagccgtcggatcttaagaaactctgtaacatagaaagattggtgttaatcctagccgtcggatcaagctttctttgtttaaaccactctttgttttgttactcagtctaaaagcaaatgtggtcaagataaccataaataaagattatgttgatacaaagagagaaaaatagttatgaatctaatagactcagcaatagaaataacaagacaaagcttgagaagcaacaatatcaatgtttgtaacacctaaaacatattattaccataactgaaatgttctctctcaccaaggcaaaccagcagacagagacttgtatatattacttactcggatagagttgctttgagatcaccactctcacttagctccataatgatatcacatcctccaattaactcacctttgtagtatagctgaggaaaagttggccagtttgagaaattcttaatcccttgccttacttcttcatcagtcaagatatcaaacgatccgaaactcacgttttctcctctcaatgctttcacaactttggagctaaatccgcatttcggttcatctggtgaacctttcatgaatagcattacttccgaggaattgatcagtgccttcaatctatcttcaagactctgttctccagtgatccctttctcggtcaagacctttttcagctcaccgctcttttgcatctccaagacaatgtctgatccacccataagctcgcctttcacgtaaagctgaggatagcttgaccagtttgaatacactttaaggccttggcgaacttcgtcatctaagaggatatcgaaactcccaaactcgattttttcttggttgaggatttcaaccactttcccactgaacccacactttggttcttctggtcttcctttcatgaacagcataactggtttggaattgaccagaccttcgagccgagctcggagggtctcacttaagcctgtgtttcctgaactaacccctcctccttttccagcttcatcctgactttcttttgaaccaactgtcgtgatcccaagatctttgaaagcatcttttagttcaccgctctcgtgcatcgctattgcgatatcagctccaccaagaagctctccgttgcagtacagctgaggaaacgttggccagttagagaatttcttcaaaccctctcgcacttcgttatccgatagtatgtcaaaacttccaaaatcaacgttaacctctttcaaaatgtcaactactttcctgctaaacccacacctaggctcttcaggaatacctttcatgaataacatgacagggtgagaattagtgagcttttccaaacggctcttgagagcatcggcggtagatacaggctgagctcggtcttgtaaagaagctttcgcattctccttcacagtttcaagaatcgttggcccagcagccaaccctaagcttgcaggagcagcaggctccgcagaagtactagaaccagcaactttgccaaccttattagctaaacttgatggatctgcaccctcaagtgtatccacagttttaccatccttcaataagaaaacgaattcacagtcagaagaaagtaacaactttcagaacaatcattacagtgcagtgacaaagattcaagctttgaacacactctcaatcctataaagacagaaaattgcaaccaaccaattaaaacaaagaatcaataagtctggagctaaatggataggcgaaccatcttcttctactacctgattagataaacagctttcagtaatctaacagagacgcaaactaatcaaaacaaaaaccctaaatcctaaactttcgatcaaaacatagggacaaagattcaaacttttgaacacactctcaatgctataaagacagaaaattgcaaccaaacaaagcaacataaagaatcaataagtatgacttcatcaatgtcttcttcttctaccaaattagacaaacaactttaagcaaaaacaaaaaccctaaatcctaagttttgatcaaatcatagggaacaaaaaaaacgtaactttaccttgaagaagacgaaataaggcacagcagcaacagagtaagcctcagatatctcaggatgttcctcagcttcaacctaagaagataaaaccaataacagtcaaaaacctcattgaaagtgataaaattttgaattggtcaagagaacagagacgaaccctaaagaagtgagcacgagggaaatcagtagcgagatgagagaaaacttgatccatctgcttcgaagcatcacaccaagaagcccagaagtgaagcacgactggtgcgccgctctggcgcaagttatcaagctccgcctttgaaacgatatccttcaccgtaccgctcatcttcgaagagggagaaggatctcttaacactttttttttgtgttgtgatttaccaatttattatcgagcagaatacactctgttgctggagaaagaaaggagatttatgtaaatataacaaaataaaaggacctaacgatacaattagggtttttgtgtgcccaatgtgatgctaaaattgctcacttatgtaatttctttttataaaaatagtaaaattatatatgtcagcggaaggaaaaaaaaattggaaattaagtaaggtaaaaatgttaaaattctaggtgataacaatctttaaaaataaaataattttgaaaaatattagatacatttaaattaaaactactaaaagtaagtttgactaataaaatcttaatcctatttttttctttctaaaattaatactaattagaggaattgtatatatcaatcctcatcgaattggattctcataaaacagtctaagaattaggttacaattctttttttctcctttgttttgtatgtgtggaattgtttaattctgttatattaaaaatccacaattattttagcatttgtatttttagttattttattatactatctttttttttaaatgatataatatataagcttacatcatttagataattgatgcatctattaatttttgtgtaacatcactatttaaaatgatacaaaatttacatcaatggaaactgatactagttaacgactaatcatcgactataaaatgtgatgtaaatgtttacttaatttgtcaaaatcctacatttctcccacaaaaaaagaggtttcatagttttcttacatatagtgaccttggttttttggtggtgtaaaaaaatataaaacttagtatgcaaagtttgccttcatattaattaatgaaattacataatactttttaaaaacaattaattgaaagtcattttatttaattaacatcgattatcctactatattatttgggaagtacattttaaatgtaacctttatttttgtaattaattacatgataatgccattagaaaaatttaatcaaaaacaaaactctttaatgacgtcattaaggttaccaaaactttgataaatataacgtggtcttacctagatattcctctgggtattcttgtgattcaattatgttcacgtctgatcggcgaagacgtttaataaggggtttgttctcggtgagaaaccttttccgaacataagcatctacagatcggatgtagaacccacgttgagccatagtttgtttcatattgtcaagaaccgttttcaagctcaatttcttagggatgtgaacatattctacatcccacaattccttaagaaaaaagaaaaaaaagtatactgatccgaaaacaattaacaaaaagcgaacaatatactactacattaccttcataggctgcaatccacctctattagtgaccacgttggtgcttagatcttgcattggaggaaatccttttggatgaggagtttttgattttgataaaaactcatctctaccacgttcaacttctttctcttcctgtttcttcacactgcgtcttccctttcctccaggttttcctcttcctccaaccattgttgacagaatcggcgcaaaatgagggttcagacgaaatgatggaggtttgtacgtattctacaccctcggtgatttattatataaatatcaatttaagagaataacctactcaaatcactaactaatccatgattattatatactcatactttgagtttggattacaaaaaaaatattcgagtatgaaaaaactattaaaatggttttattgaaaaatcatgtaatattaaaataaatttagtaatagtacattaaatatgtaaaataaaataatataaaaataaataataaatgtatcattaacctataaattagaagttgaagagcttacattaattatttaatagacacatgacaaatatatatgattttgaccaactttcatatatatgattttgataaactgatgcaaatacttagaacacttacaaaaagtgatttaaaaagataacatctttttttttagttgactcaaattaacattagttacaacaagcaatgcaaatattatgtatacttttaaattatttgcatcaacaatatatacatcatttacttaagcgatataaattatttgcatcaacaatatatacatgagtccactaaccttaaagccaacaacaagatttagagagtcttaaacttacaattggcaaaaaagactcactcattacatcaaccatcttgcaacatgagagcaactcttaatcgcatatttacatttgtttaaatggtgcagatcaagatcttttaaatccctttttaagttaagtagttgcaagttgcagagacccgcaagcatcagaagcatgcttgccttctccaaaaaccaagttccctctcacaaatgtcgaaaccactttgcctgataatcttcttcccaaataagctgagatactctattgtacaccacaagaagcaaacataacataaagattacacattcgtgttattcgagcttaaccattagctatctttctagaaaaaactgtgtacttacagggtgtttgaagtgaattggatgatcttcatctacatcaaattcggcttcaggttcccacacaacaagatctgcgtgttttccaaccgtaaccgctccctataattaaaccattacttataagctgcgataaatggaccccgaatcctaataaaaacacgtctatattatgccagtgtgctgtgtatggacaaaaaagagaatactgaagctgcgtttttttttataataacgaaccttagagtgtagtccagcgagtttggaaggcctatcactccaccaagaagttacctgctcgagcgttactccatacttttttccataagaccatgtgataggaagaacaaactgcaattggctcttccatgagtttttttgtgctctcacagtttctacatattacatttttaagactaaacgaacctgtaaagaagatatcccaccccaagctttcaagaagttgccatcactcataagtttgagttcaggctttgtaggtgaatgatcagagctcagcatatcaatgtctccttcctaatcaaatcaaaacctcagaatcaacgagtaaggtatcacaacaaagattgcgtaaaatatatattataccatcaaagcttcccacaatttttctctatttgccgcatcacgtataggaggggagcatttgaaacgagtatcaccttctggaatctcttcggctgagaaagctaggtaatgtggacatgtttcaacagtaacactgtctcctttgccttttgcttcctttactccatccaaagacaaaaaaaatatgtaatgagatacaaccaaattctagtgcttctactgcttgaactcttgaatacctttatcaaatccaaggaagaactggcatcagataaatgtacaatatgaagatgagctccttctgcagaaccaccaattcttgtgttttcagtaaccgataataggtttctgattgctccctcctccctaattgctcaaataaatattcctttcaggtacaatgatgactctgtaggaacttatatatatagagtgaaaagatgcaatatctcaccatgaagtaggcctggtttttaaataagtcagataagaacgaggatcattttcactaccatcttcaatctctaagtctctctcgatctctgcgtgtacaagcaatggtcgtttgtatttagctaatacagatagtccttcctgcataaacaaacagtatcagcgagacaagggccaatgaggtttttgtaataactattgaatcatgagagaaggatcataagactcaagaaacaaaacctttatatgagtgatgtttgtcattggaaaatcgttgattcctgaagggcacataaaggactgaacaaagattgagacaagtcattatagacagaaaagcaagccacagctttataggacacatgatagattgatatctaccttgagaccaagaactccagcatctaagagagactcaagagcacttgagttgagtgcattgtcaggtaccagacctccccagaaccctggagaaaaatggaaacaaagatttagggcacaccatgtgttgtcttgaatcaacagatgtggtaaggtttgatagcaaaaagtgtttaccaacatcaacatgtattctgtttttcgcagcttcaatctgtaaaggcaaaaagctgtaagaatagtgtcgagcttaccaactggaaaactaaagtggatggctttaccttgagtttcaaagtttcaggagatacagttgaagggaaactgtttaagggcatgtcaaccaatgtagttattccccctgccagacaaagacattcttaagaagctgaataaagcacgtaagcgaagagacaaagcagaacacactcatgcaactagaacagtctcagtaagagaaacagatttgattaccagcagcagcagccttagttccagaaggaaaaccttcccattcacttcttccaggatcatcaagatgaacatgccttttaaaaaagttgcaagattttaggcggaaactagacaaaaatctgaatcatacgatggttttaaagatgacatacacatcaatgagaccaggcatgaggacagcttctccataatcaatcactttcactcgactcctttgactcttatgccaatcaacttccttcaccaccgacacaataattcctcccttcacctccactgatcaacaaaataacaaacagtagagcagagcttagcaccggatcttcaaagctactaaagcaacatggttccatggatttccaaagatttgatgttccattagaactcaataataaatcagtgtcaactttagctaataaaccagtggcttggagaacaagtgacctaagttcgaatcatgagtgtgtacaagttgatgaagcaacagatggattctgattctgattcaaaagaaaaaaacgtaccagaaccagagatgagaccattaggtgtgacgatgcgtttacttgagatccagtaatgatcatgaggaagaagactacacttattattcccctgcaacaaccaaaaacaacggaatcagtaaaacagagccgccatattcgccggcgaatcagattacagagaaaacggtttcgagaaatcaaatcaaaaacctgtaaagagcgaggagaagcgaagaagaaggagaaaagagcaacgatgagtgcgagaagaggcaatagtctccattgaagcaaagttctctccatatctctctcttgatctcttctgcgattatttggagagagcttctcttattggctatgaagcggggcctactaaggattaaagattctttaaaagattcggttatagaacaagccaggagtctctaaggaccgttagatcgtgtcaacaatcgtgaagatcgacggttgtggtgagatattaagcacaacttggactgtgccagataagattcctctccttcatggtttacttgtgcattcaacaagtccaactaagttttgtcttttccttacttgaaatagtatattttgtattcttctatagactgatcactttttaaatgttgtttctgatcacagtaatgggccggatctttattatttttaaggcccatgcacataagaggtccacttattatgtgaattaaatgatattaaaccaaattacccaaaacaactcaccttttttccccaatagttaggacttaggatcattgataactgtttattttatagacattttagtacgctttttttttgcaattgtaaaaatatcatattgaatttcaattgaaccaagataatcattttaaaaaaaaatctatgtaaacatatggtcttaacaatatcataaattaataattatataaacttatcataaaataaaatatatatatatataagaatatttaatgtaagatgactctaatgttgtttacttttttgtagtgaagtattactttatccaaaacttattgtattatcttctaataattaaagttggtgtttggtatgaaaaattctaacaatttttttttaaaaatagaatgatttagaaacaagttcaaaatttgtatcatctaaaaattaaatgtatatgttgtttgtattattgatttaggatgagaaaagagtaattcaaaggctttgtcacgacgacaaagtctgggaagaggatgagaaacacatgcagattcaccacattgatcataactcattcatttttgaaaactcacctttattatatatctgattttgattttcttgcgtttttggaatcgaagtagagaaattcaaggtttcaaaactaaatatatagtaaaatttatagttgttttttttatccaaatgtatcatttttttttacatttttctgactcgtaaccgaaaaatttattgatttaaagagattattattttctcgattattaatatatagaagttttacataaactcacctaagatagatcactaactctttgtccaataattgggcaaaggacaagagaagagatactaatctcttaggataaatcatttattgatggaaaaaaattatgtacaaattttgtaaatatttaatattttagatgattgttgtcgtgcagtatatttatgagactgtcgcatttggttttatactatccaaaagatattcgataaaagcaaaaataacaaaaaatggaagtaaaaacaaataatctaacataataaaaaaatataaaccaaaaaacaaacatatataccgtggctaacacatacactcttttacctgggtcataaaaactaacaaaagtatatcatagatatactcatttattaattacctattgatgggcggcgtactttatttaagattttataatattacattgattgccataattgcatacatagtgactatgtgattgagtagtatagtaaatatataaatgaattatatggggttttacttgggacatagaacaaagctccagtcttttctgatgatcatcgaacttcttggattccagcttctttactatctaggtatcatcaatctcatttacattctctccaatcaattcatcccaatttttagttctttttcgtctaatttctgaggaatctcaggaattttagaaccaataaagatcttatacctttgaatatcgtaggaatagaggtaccaaagaagacagttcttcgaggtaggtcccatatcaattcccttgggacatctattgggtttaggctggatgcatgatccgcaaacatagcaaccgagaactcttgaattgaaaatctgataggcgcttcaccaaaatccatccaaatctcgtgctttttcgccgtcactaacatgtaatgagcgaactggaccgaaaaagctacttctcgaccgtgctcaagcagatacccgaactgagaattacaaagctgtgaccattctttctcttgcttattcaacgcatacttcacagtgtcctgatatttcaattaacacaataattaaacttaaaaagtaaaaaaattatcttttaagaaagataattttaaaatatatacatataaataaataaccattcattaacttatctagatatatatttgatatgatctgatatacattttattttgatataagtgttttaacatttattctttaagatgaagggtctagaatcaaaatccagtttgtcattaataaataatagttaaattgtatatgaatataaatggaatgtgtaagatttgaatatttttcaataaaagtactaaattaaatataggaaaagtgtacgaaatactatttagaattcaaatatcatcaataagatggagtgtctagaattaaaatgcccttttttattattaaataaatagttaaagtgtatgattgaaattttgtttgaaacaaaatatgaaattaaataataagaaaaatatagattattatttagaatttaaatattatcgatatgaaattatatttattttttacactcgcatatttaggcgggcattacctagtttttatatgtaaaataataattttgtccatatttaaatcaaaaggtgtatttttagtaaaatcaaaactaaattaaaaaaattgagagaaaaagaacaaataaatttgaaacatttttaggtatcccttatatattaattgagaagcatgttttaaaaagaaccttacacttacgtgtgattaacgacaatgccatgatgacatgtcacgtttatagagctcgtcaacccatttaattaactatccatcttttactagaatatttacatcaatttggtattggtattaataacatttgttttactcattggttaatccaaaataagtattttttttaaatgtactctcaacaaatctacaggttgaattgtaatcaatttaaaatgattaatatctactaaatatctaaatatatggaatctaacaatatttgataattgatttgtaattccaatttttccaccgattatggtactttaagttaataataatcaaattttaattacctcaaacatgtcatatatggacttatataatgttagcatacttgtttaagtttaccatgtatcctaacaaaagaatattgagatatattaattgacttattaaaaaaatactaacaaaaataaaatattaagaaattatgatctagaaaatatacatgtaagaaataaattttgaaggtactttatatgaaatatcgattttaaaatatttaagaaatcagaaaatgtaggaatgatgtatttgccataaatgataatatttcatcaatactttcttcacatggaagtttttaccatgctcaaatattttacgggtgaaaacaaattcttatacaaatttgaacagaacaaaaaactttttattatacgtttcattttatacggaatttgaataatcccgtatactaattttacttcaattattttatattgcacatagtgcgggttgttatctagttcttataattatttttgagacaataataatctaattattttctatattaaacaagatcaaatctagaaaaaaatataaaatctatcccttaatattgtcatgttatgtaaacaaaaatatctcaacgtaacaagccaattcttcaactccaaagtctgcctctattgtaagattaacgtagattatgattttttaacattgatagaatgatttaatatacatgtttattgattaagatcaacgtacgacttatagctgtaacataatattttttgttttatttacatgtgttattgattagagatagagtatccaaaaaccaatggaaatctaatcaaaagtaattttagtcaagagattttgtaagtaataatgagctatttaattttaatcaaacgtaggaacgtgaatcacttgataggtgaattcacaattattctatattgtttaaaagaaattttaagataaaaattatctttaaaattgttagttacttcaaatattaattgaaaaactaaattaatggattttctgttttacgtgtaaattatttttaattattatttacggaaatatttttagtaaattaatatattaaaatatagtttttaaaagaaaaacaaggatagggtagttttcaaacaataactcatttttgtttctttctcatttctctctttctcttactcgacttttggcgacaataacgaagctttgcgaatctcttcgatttcggtggatttaaatacaaactacaaaatcctagtctaattttcaagacctatgtagaaatatcgatgtatatgttaaatataatcaactaaatgacataactatatccacttacttgatatttagtggtgtaacagagatattagtttcaaaactgaaaatattgaatattaagcatatagatgaggcatgtaattgaatacatcagatagatatattcagtttctagataaaagtagataacatctcataagtattgactcttttgaacaagacaaataagatgtcatagatttgtataaattacaagcttgaagaagttgttagcactgatttacaactgtgtaattcttactcttactatatccttccgtatattatatatcatctatttaaaactactttatctaataagtagcaatctgcataatacaaatgatcataaaacaaatataattaattttgtactgaaataataaatatcaaataaacttgtaagacatagggcatagccattagttacttaagtacctcattaaaatttttgttctaaaatgtccgatttattatatttttaagtcaaaaacatgaataactatatatataacgcatgtaatataaatttaaaactaaaatacatctcgtgcaccgcgcgagcctacttcaagtaaattatctaatatattagtaagaggtaagtggatattacttttaatgtgtgaaaaattcttaaacaacacttcaaatgaaataaagatagtgtatgttactccaccattgaaatcaaaattcaagaaaggataacaaaaatggtaggaccatattccagcaatccacaagtgacaagtgcttctgctggttatgttttacccaattttgtggatttcatcaattgattggatgataatggaagaatatgcatagtcttttctcagtactactttaaacccacctatctaggttaggcccgtctagataggcgggtttaaaaaatatttataaatttttatcgatgatatttgaattttaaatagtaaatgataattatttttaaatatttaatttagtaaatttgttttaaattaaattttaatcttacaataatcttacattgcagaaaattgtaatattgaaattcgatttaaaacaaatttactaaattaaatatttaaaagtagggattatcatttactatttagaattcaaatttttggttaatgggatctcaccgctatagattcaaatatttttataaatttgttttgattagaaccttggctataataaaacaataataaaatattaaatatagatgataatatagaagaaaaacatatgaaatcgtaatatttttaaaaaaaacagatgacttaaataacgtaagtagatcaaaggaaattgatgcatttgatgctcctgatataaattttttggaccgttctttcaggtttgtttaatgaattgatccatatatttgtgaacataaatgttggcatggatcaagcggcgatcttgcgaaatttgacatcgaaaatttcgtataaacgtatcaagaaatttactcttgttaataagatattagttttagttaaatataactaattgtggtaataatctaatagttgaataaattatcatcaaattgagagattaaggtttgaccgtttgagttctcttttatatgataaaaaaatatctaacattctatatatctcaaagattgattgggttgggattatatccggttatattaaaaatattatcaacagtgattggtctgtaaaccaggattaacttcagtttttttatatacaaacaaaggccaagtcaacgaacgtactaaattaataattatgttttcttttggtattgacgactttgcataaacaaatagaggtaggaagaaaattcggcagacgatatgttatggtgactttcatgtcgatttcgagtttgtgaaaatataatgtttaaaattgggtccacccacactattcaaaggtggttttcatgttttgctatgatccttgacatttataaaaattctaacgtatctcgatataaatagctgccatattttgatttttctattagtcaaactcacatttgatccttatctaaaatttccaacataactcgagattagtccaactgactcaagccaaaggtttgaattctttgtacttagttcagattcattcagcactaatttcactatctttgatgagtattggtctagtttacttgcttcatttgagtttccaaaatctttgactacttctcatactagtttcattcatcttttcgtactaatctgtaactttcaaatgatgtccaatttggaagaaggaaaaaaaagcttgagtccttaaaatttctaaattaagattccgaatggagacgtgcggttcaactgcggataaagtgcggtgcggttcaaatagtaacaaattatatacatatatatatgcaaagaatttcgttattatttaaaacacactgcactgcggttcggtcaccattcgaaacctaagatccaaaattatttcaaaaatatcgcatactaaaaaaatgtggaaaataatcagcataaagtcgcagggattagcgattaaaaaccaaccttcatctctttttaatcttttcttcatctctttcattttctgtcgataccactttttttggtgattccgtaaacagtgcaaataacatcgataaccttggaaactcttttataatatagcgacaatcaatggtgtatagatcttcaatctaaatacactacacacatcacaattgatatttttttagcaagaaactctcaaatcttccctctgtattaaactttactagtttgacaacgagaccaaagaatacatattacaaatccaaatccaaaatgtcataaagttgactaaaaaatagtaattgtataataattaaatcaaacctttcatgaaagcttttaacaactgtcattatttctcaaagctttatcaacccccacttataataattaatttttaaaagattttcttaaataacttgtacaaatatagtatcaaattttaaacctatgttaagtactacaataacacgctttcctctgtattattaaatcattaatacgtatatgtgacgagaccaaaagtacaaaaagtccaaagtacaaaactctcaatccccaaaaagtctcaaactttgacaagaaaaaaacagtaaacagagaataaaatgaaaaaatcaaacctttgcatcaagcttgcaactttccttttcaacatctgtcttcattgcctcttaagccccaattatgacaacaaacctcacgcgtactgtcttcttcgtcttgttcttcttcatctaccatgaaagctcttctctttcttcttacccttttcctcatcctcccaaacccaatctcagccattgatttcatcttcaacggcttcaatgactcatcatctaatgtctccctcttcgggatcgcaacaatcgaatcaaaaatcctaactttaacaaaccaaacatcgtttgcaactggtcgtgctctatacaacagaaccatccgtacaaaagatccaatcacatcctctgttttacctttctctacttctttcatcttcaccatggctccttacaagaacacacttcctggtcacggaatcgtcttcctctttgcaccatccactggaatcaacggttctagctctgctcaacacttaggtctcttcaatttgactaacaatggtaaccctagtaatcacatctttggagttgagtttgatgtctttgctaatcaagaatttagtgacatcgatgctaatcatgtcggaattgatgttaattcacttcattcagtatattctaacacttctggttattggtctgatgatggagtggtgtttaagccattgaagcttaacgatggaagaaactatcaagtttggattgattatagagattttgtagttaatgttactatgcaagtcgctggtaagattcgacctaagattcctttgcttagtacgtctttgaatctctctgatgttgtggaagatgagatgtttgttggattcactgctgctacagggagattggttcagagtcataagatcttagcttggagttttagtaattcgaatttctcgttgagtaatagtttgatcactactggtttaccttcgtttgttttacctaaggactcgattgttaaagcgaaatggtttgtttttgtgttggtgttgatctgtttcttggttgttgctttggttggtttggtgttgtttgctgtggtgagaaagagattagagagggcaaggaagagagcgttgatggaggattgggagatggagtattggcctcatcggattccgtatgaggagattgaatccggcactaaggggtttgatgagaagaatgtgattgggattggcgggaatgggaaagtttataaaggtttgttacaaggaggggttgtggaagttgcggttaagcggatttcgcaggagagtagcgacgggatgagagagtttgtggctgagatatcgagtcttgggcggttaaagcaccggaatttagtttctttaagaggatggtgcaagaaggaggttggtagtttcatgttggtttatgattacatggagaatggaagtttagatcgatggatattcgaaaacgatgagaagattactacccttagttgcgaagagagaattcgtattttgaaaggtgtagcttcaggaatattgtatttgcatgaaggatgggagtctaaggttttacatagagatattaaagctagtaatgttttacttgaccgagatatgataccgaggcttagtgattttgggttagctcgggttcatggacacgagcaaccggttaggaccacgagggtggttggtacagctggctatttggctcctgaagtggttaagacggggcgtgcatcgacacagaccgatgtttttgcttacgggatattggttcttgaagtaatgtgtgggagaagacctattgaagaagggaagaaaccgttgatggattgggtttggggattaatggaaagaggtgagattctaaatgggcttgatccacagatgatgatgacacaaggcgtaacagaagtcattgatgaagctgaaagagttttgcagcttggattgctttgtgcacatcctgatccggccaaaagaccgtcgatgagacaagtggttcaagtgtttgaaggtgataaggctgagatctttgaagcagaaagtagtgaagatgtcgagtcatggatgttgatgaagatgggatctcgtggaagctcgcgagagttttggtatggaagctcatcacatccgacgatagagcagattagacttcagtctttgtctgtgtctctttcgtcttggaacagctcaattttagaagggaggtgatgatgatgaagaaatggcttgaggaacctaaagaatgtagttatttttgtggctttactttgttacttgttttgtacatatacgtatttgtaaacgcatttcattatacatgtatttttttattttaatttttttgttgtgaattgaaactagttttcaatttattatattttgatgtgtatataaacaagttttgcatccgaagttaaatgataaataatttaagagaagtacttataataatgctaacaaagtaaatgtgtagattactataaaacatacttttttactaaaataggatttatgttcttaagtattgaacatgagaaacatgttttatggtttttttttttttttttttttgtcatcatgttttatgttcttaagtattgaaaaaagtagtactagtatctggttgatgaataaaagattactctaaaacatgtttttactaaaagaggatttatatcaataaagcttggttatatatatatgaaaatatatatatatttttttaaaaaccttattcctaactacacccttatttatttatctaaatttttatttatttcaaaaaagaaaaatacaatacaaggctttgtacatcattctcttattaaaaagtttagatctcacataagaagttctatcgaaatttacaattttaatatacaagattacaataaaaactaccaggtttccgatcataaatttcagataatactaacagaaagaacgacaatcacatccgtcgatcaaagtttttgtaaaagatccttcgatttttttgtatacataatgatattatttaaaattcaaatatcatatacatatttacaatttttgtatgtccgcctatctatggggatcttatctagttaatcaatgaaatttggttttatatataccaaaaaacaaacattctgacaaggtctaatttgcatattaatgtaaacacatcatataaaaattcctaattgtcacgagttccaggtaatcattcatatactataatgcatatggttgccagagaggtatatttaaaaagcttttcatctttggaaaaagcataaagttatgttcatgaatcttataaaatgttttaaagatagtccttcacaaaacaagacaaatcaaacgacacaaagattcgatgctgcggtgtcctaaaaagttctctttatttggagtctcaaaatctaattcttatttgttttcctcaaaacactttctgtgaaaatttcgaaatgtcactacactgtgagtttagcaaaagagtttttgttcattacgttctaattctatgattatctaatagattaagtgccatcactttcattcatgagcacaccatcactagttaaaaagatcaagtgcctttctcagttaatcctaaatcctagttaatgtggtgtcgttttgaccaatccattaatacgttgccgttttaaaatcccaccacgagcataatataacggatataatgctatcttgtcttgtttctctctagatttcagagattctctcgagtttctgacacgcgcgtactcgcacgtgtctcatcactacactaaccctacacgtctccctttcgtggacgctccgtttacttaatctccaccatcagatcacatcttagataaaagcctaaaatcaatctaacggtcactagctcaaggagtatgtattattgtacgacgagacacacatcgttatctctctttattatttggtaatatcataattattatctctatgcacagtttttgtttcgtcactgtctttgaaacttaaaagaaaagagaagaaatagaaagaaagaaaaaaagatgaaataattttgaaaaaaaaagattcgaagcaaagaaaccgttagccggcgatgagaaggcagcggccatcggtagccaccgcgcgtgatgcgccgtcactagaggtatacaatatcattccgattcatgatttcttaacggaacatccgtcgctgcgttatccggaggttagagcggcggcggcggcgcttagaatagtcggagatcttccgaaacctccgtttgctgatttcacacctcgcatggacttgatggactggcttggtcttctctttggttttcaaatcgataacgttcggaatcagcgagagaatctcgttcttcacttagctaactctcaaatgcggctgcaacctccgccacgtcatcccgacggtctcgatccgactgttctccggagatttcggaagaagctgcttcgtaattatacaaattggtgctcgtttctcggagtgaggtgccacgtcaccagccctatccaaagccgtcaccaaacgaacgccgttttgaatctccgccgtgagcttctctatgttgctctctatctattgatttggggagaatctgcgaatcttcgttttatgcctgagtgtctgtgttacatttttcatcatatggctatggaacttaataaagtcctcgccggagagtttgatgatatgactggaatgccttactggccttccttctcaggtgattgtgctttcctcaagagtgtggtcatgcctatttacaagacggttaagacggaggttgagagtagcaacaatgggacgaagccacactctgcttggagaaattacgacgacatcaatgagtatttctggagtaagagagccttgaagagccttaaatggcctcttgactacaccagtaatttctttgatactacacctaaaagcagtagagtggggaagacaggatttgtggagcagagatcattttggaatgtgtatcgaagctttgatcggttatggattttattgcttctgtacttgcaggcagctattattgttgctactagtgatgttaagtttccttggcaagaccgtgatgtagaggtctaaaagcttctcctttgtttgatctaattacggtaatatgtgttttgagttggatataaagacattttctgttcttctacttgcaggttgctttgttgactgttttcatctcctgggcgggattgaggttgctccaatctgtgctcgatgctagtactcagtacagtttggtgagcagagaaacttattggcttttcatcagattgactttgaagttcgtggtggctgtggcatggacagttttgttttcggtcttctatgcaaggatttggagccagaaaaataaggatggtgtatggtctcgggctgcaaacgagagggttgtcacgtttctcaaggttgtgttcgtttatgttatacctgagttattagctcttgtactctttattgttccttgtataaggaactgggttgaggagttgaatcttggagttgtgtactttctgacatggtggttctatagcaagacttttgttggtcgtgggatgagggaaggtttagtggacaatgttaagtatacactcttttggattattgtattggccactaaattcatatttagttacttcttacaaattaggcctctaattgctccgaccagggcactactgaaccttaaggatgcgacgtacaattggcatgagttttttggtagcactcacaggatagcagtagggatgctctggctccctgttattttggtttacctgatggatttgcaaatttggtactcgatctactcatcccttgtaggtgcaacaattggtctgttttctcacttgggggagatccggaacattgatcagttgagacttagatttcagtttttctcaagtgctatgcagtttaatcttaaacctgaagagcatcttctgagccctaaagcaacaatgcttaagaaggctcgtgatgctattcaccggctgaaattgcgatatggaattggtcagcctttcaacaagatcgaatccagtcaggttgaagcaacttggtttgccctgatttggaatgagataatcctcacatttagggaggaagaccttatcagtgatagggaggttgagctactcgagttgccgcctaattgttggaatattcgggttatccgttggccgtgtttcctcctttgcaatgagctcctacttgcgctaagtcaggcaaacgagctctgtgacgctcctgatcactggctttggtcaaaaatctgtagcagtgagtacaggcgttgtgctgttatggaagcttttgatagcatcaaatttgtgattcttaaaattgttaaaaatggcacagaagaagaatccatactgaacaggttgtttatggagattgatgaaaatgtggaaaacgaaaagataactgaagtatataagctgacagtactactccggattcatgagaagctaatatcacttcttgagcgtctgatggacccagaaaagaaagtattcaggatcgtgaatatactgcaagctctgtatgaactttgtgcatgggaattcccaaaaactaggaggagcactccgcagttaaggcagcttggcttggcgcccattagtttggaagcagatactgaattgctgtttgtcaatgccattaatctccctcctcttgatgatgttgtcttttataggcagatacggcgggtccatacaattcttacttctagagatccaatgcataatgtgcccaagaatattgaggccagagagcgtcttgctttctttagcaactctctctttatgactatgccccaggctcccagtgtagaaaagatgatggctttcagcgtgttgactccttactatgacgaagaagtgatgtatcgacaagaaatgctccgagctgagaatgaggatggaatttccaccctattctaccttcaaagaatttatgaagatgaatgggtgaattttctggagcggatgcgtagagagggagcagagaatgagaatgatatctggtcaaagaaggttagagatcttcgcctctgggcttcatataggggacaaacattgtccagaacagtgcgagggatgatgtattattatagtgccttgaagaaacttgcctttcttgattctgcttctgaaatggacatcaggatgggaactcagattgcccctgaggcacgccgttcgtactacacaaatgatggtggggataacacactgcaaccaacaccttctcaggaaattagcagaatggctagtggtataacccacttgcttaaagggtctgagtatgggagtgcaatgatgaaattcacatatgttgtggcatgccaagtttatgggcaacataaagcaagaggggaccatagagctgaggagattctgttcctgatgaagaatcatgacgcccttcgtattgcatatgttgatgaggttgacctgggaaggggtgaggtcgagtactattcagttcttgtgaaatttgatcaacaacttcagagagaggtggagatctatcgtatcagactgccaggccccttgaagcttggtgagggaaaaccagaaaaccaaaaccatgctctaatctttacacgaggagatgcgattcagaccattgatatgaatcaagataaccattttgaggaggctcttaagatgaggaacttgttggaatcattcaagacttactatggcattaggaagcctactattcttggagtccgtgagaaagttttcactggttcagtatcttcactcgcatggtttatgtccgctcaggaaacaagttttgtaaccttaggacagcgtgttcttgccaacccactgaaagtgaggatgcattatggtcatccggatgtatttgatcggttttggtttgtgcctcggggtggaattagcaaagcctcaagagttataaacatcagtgaggatatatttgctggattcaattgtactttaagaggtgggaacgttacacaccatgaatacattcaggtaggcaaaggaagggatgtgggtttgaatcagatctctatgtttgaagccaaggtagcgagtggtaacggtgagcaagcattgagcagagacgtttacaggttaggtcacaggctggacttctttagaatgctctctttcttctacacaacggttggctactatttcaacacaatgttgatagtatttactgtttatgcattcttgtggggtcggctttatctagcacttagtggtgttgagaaaatagcaaaggataggagtagcagcaatgaagctcttggtgcaatcttgaatcagcaatttattattcagctaggacttttcactgcacttccaatgattcttgaaaattctctcgagcgtgggtttcttccagcggtttgggacttcataacaatgcagctgcaacttgcatcgtttttctacactttctccatgggaactcgaacccattactttggccggactatactccatggtggagccaagtatcgtgccactggaagagggttcgtggtggagcataagaaatttgctgagaactacagattgtatgctcgaactcatttcattaaagctattgagctcgcgattattctgttggtatatgcggcttatagcccgttggctaagagttcgtttgtttacatactgatgacgatttcgagctggttccttattacatcttggattatttctccatttctgtttaacccttctggcttcgattggctcaaaacagtaaatgattttgatgatttcattgcatggctatggtctagaggcgggttgtttacgaaagcagatcagagttggtttacgtggtggaatgaggaacaagagcatctgaaaacaaccggagtgtggggaaaactgcttgagattatacttgatcttcggttcttctttttccagtacagtattgtgtaccatcttcgcattgcagagaatcgaaccagcattggtgtatacttaatttcttggggatgcatcatcgggattgttgcgatatacatcacaacaatctatgctcagaaaagatattctgtcaaggagcatataaaatatcgattcattcagttcttagtaattctccttacggttcttgtggtcgtgatgatgctgcagttcactaaacttacagtagttgatttgttgataagtctcttggcttttgttcccacaggctggggattgatttctatagctcaagtactgaaaccgtttctgttatcaacagtggtttgggacacagtaatctctgtggctcgcttttacgaccttttctttgggctgatagttatggctccagttgcattgctttcatggttgcccggttttcagaatatgcaaacacggattttgttcaatgaagcttttagcagagggttacagatttctatcattctcgctggcaaaaaatccacttgaagcaaatattgggtatggttcagaataagatcttctttatatgttacactgattactattaactaaacatccattaataagactgatttcatcatatttgcagggttcttaaagtttttgaaatgagttggtctgagaaggttgggcgatatccttttctctagcaaaaaaagttttgcttgaagcagcttatggtagcctggtttaatatcatcctccaccgttttgtggcattgctccaggttaagcctggtttttcctcatggtggttagcattttggagttgattgtttgaccttggtttggcttgtttataaacatataaggtatgtatctatcttcatttgctttggtgactgattttatttgtcaagaccttacgattaaatacataattttgtcatatttgcagggttcttgatttgttgagagatggtaatatgagggagcttagaaaaatgacggtatgcttcacactgcaccagttgttttggtcgtgtacagatttgacccttttgcatttgttaggagactcttgcttttaacaactcttatgcacatagtttgcttgtggagacgatttttacgtgctcttagactcttcacactgcaaatgcgtgtccaaccgcatcatatcacttatgtaaacaacatttctcagaaaatggctcatttgagctctaattaatttcagatgacaaaaaaaaaaaagtttgcttttggagagagatcttttgacgtctttcactcttttttttcttaagcgtttctcgaatcattttgtcatttcttgattcaagtttattgcaagagaatcatactggaatcttacgtgattataaagcattgtaaagcaagaatggttttttacttttaacaactccgaaaaagtgataactttgacaaatagtcaatagatatacgatcatggtattatactttagaccgggatatttaagtaatttgaaagtcctttaaacaaatgttccataatatatacttgataaccaaagttcgttattggaaatatccactaggcttttgtatttttgtgtaaagagatatgttcatctcgaaatgtcgaaagacaacatgataatgttttcctatgaactctctagctcttctctcatggaagtaaacaaagaagagatcccacaagtacaaaatccttttcaatttgaagaagataaagaagaaacttctttaggaaagagaaagataggtaagttgttctattacaaaacccatcaactcaagttttagagttgtgctctgtctgataaattcgactttaatagatcataatgatttgatatcggcagatacgattattaagactgaagatgaaagggaagtaaaaagaatagccttcttctctcaagaacctctagaagaagaagaagaagaagaagaagacattgatatgatcgaagaagatacagagagagaggatcatagagataatagcgacaagatcatggaagataatgttcttgaagaagagtctgtcgttgacttttatggattcttttgaaacttgtcttctctaagatagcctctcgttgactttttcgtttcttaagctctttgcttgattgcttctttgtcatgtaattatatatataggaaatgaaaaaatgttctctgtctctttgcattggtccaaaatcaaaactagagacacaaaaatgtaagtattgtaaatcatcttcaagcatcaacctcttcttgatttgagtgagtaaaacatgtgatgaagctttttctggttttcaagacatgatcgatgattcggattgatcaggatctgtttgaatctcatgtgcaagttgtctcgttaaacaatctgctcgttcatcgtgacctcctgcaaatgtataaactttgaaagcaaactgaaaagccctccatagcctcttagctctctcttccttcatcttgctttcttcaccgttcttcgcttcctcgttcgcttctctcctctcctagaaaacaaaacgagtcagtctttcaccgccgagaatcaatttgtgtaatttatgtgtatatatttttacctttagtgctaactccatgcaatttgatgaaacatcaaccatagtttctttgacttgaacaagaacttcgaaatcaatgttaatgttgtatctcttaaacattttagcgtcttcgtcttttgttcgctcaaccgtttcaatctcgcctttaaatttgttgaagtaacgctctatcttgtcgagaagatcgtttaatggaggctcaattttccagttcttgagctcaactagaatcccatctaacttcttgtacaaggcaccagctgttcttattacttctagtttcttctcagggaaaccttcaaacctcgcgagaacctaaacaatcaaacgacagattcatatttcgagagtgaaaatagcgactcgattcaaaaaacactaggagaattcatacttgagtttcatcagttagtttctcaagaatagattctactttgctatgaaattcaagcaactctttcatgtcttttgtctggaaactatgtattgaggatttcagttcttcgatcgatttagcgtatttctgaacatcttcttcgatttgctggaaataacttgacctatgacacaaatgaaagacagtgtcaaactcaagacatataggtttaacttgtggcgcaagtcatctacctctttgtcatctctgcaagtgcatcagccattcctgatcttgcaactttaacaggagatttctctgcaacactattttgccctttacttgctttttttgttttcccttctacgccacggccttcaagcttccctttgagagcccaatagagatttgcgatttgtgctgatcttcttaatttgctagttgctttctttaaggatcttccgctacccggtggtgctggaggtgccggcatcgacggagcattgtctccatttgtagaatgcgttttcgaaaattgacaaaactctccactttcagatgcttttgacataggaggcggcggtggaggagctggagctttgtgttccggtgatggaggtggtggtggtggttgtgagcgaagactagattttgtgttgaacgttgagaccgttggtgacggcgtttgcggtgatgtaagtggtggaggtggaggcacatcttcttttggagaagattctgttgaatcagtctctgaagtcgtggtttcactatgatcctctgtttcattctcatgctctgtttcgaaaccttcaatatgatgatgctctgtttcaaaatcttcgatatgatcatttgcatcaatctcatgctctgtttctaaaccttcaatatgatgatgctctgtttcaaaatcttcgatatgatcatctgcatcaatctcatgctcagtttcgaaacattcaatacgatgatgctctgtttcaaaaccttcgctatgatcctttgcttcagtctcatgctctgttccagaactttccctatgatgttctgttttaatctcttgctctgttccctctgtttctaaaacagagaaatcattatcttcttcttctttttcttctgctaatatctcactctcttcattttcttcttcgataccaatctttgtttcactaacactctctgaatctctctgtgacaagatctgcatagcaaaccgcttcaaatcaacaggacttaacctatccaaagcttgagctcttaagttccatagacttggagatgtagagttactagacatcatcattgtccctggaagtactgatctcggtgttaatggagatggataaaaagagttgttactttctgaataagaagcagatcttgtaaagcttcttcttgcttctgatgaaacaccttttggtgttgtaaaactctttcttccttcagattcaagatccatcataccaaatctttctctcgtcgttttgattagtccatcaagagctgctaatacatgctccactgaaacaaacaaacaaacaaaaatagtctattaagagttctgtttcacattctagggttcaaaaaagtgttcaagtaaacaaacctagacgatctgatttattcttcccaactccactgtttttgtacttagatcgataaatccagtcactatccataatccaagaatccccaatagctctgagatcttcgtagaagaaaattaacatctgtttttggggcatttctggggttcatcaatcagattaacaagactcatcaagtaaacaaactcaagagtttttctattttattcttttttgttggagtgtttgtcaagtaactcaaaatctgtttaaactcttatgtgtaccttatccatgtcagctccttccatttcaaaagattgattaatggttacaatctcaggagatagcttttgtagatccttcattgtttgtgttataatctataacaactcgaaagcaaacaagacattagggtctttagctcttttagatctttgtgttataatttatctttagctactgacctcggtgacagatagagaaccatcaagagaaggtaaatcaatcatatctctaaaagcgaatatgtttttccttaactcaaccatcaaaatgaaatttgctgagcatttcggcgaagaaccctccaaagtgttctttctaggtgtattcgctttcgtctttgagttctttactgacaaaggagacgcggtcgcggtgggagtagaaacatgttttgtagaattgaaactctttggagaagaagcttgtgcaacagaagaagagatctgtgaaactgtgcgtctgatctctttatttttctttttttcgacattgttctttgatgttgttgtgcgtctaaaatcgtgttttcctttgataagcctttttagagcaagccctcttgcgacctaaacacaacatcataaagaataatattttaacatgttaatgcaaacataaatgtagatgtgagtcaaaaacacattaagttctgtaaaaataaaatttttttttcagtttaactttttgataaaataagtgtgtaaaatacaaacacaaatgccaaacatatgtccttccgttcgttagtttgtttttttcatcttttagtattagatttcttctttggagtcttaaaacccgagcagactatttagcgaagaaagctaaagctcataatagcattttctcccatgtaagtatatcggtttatgaatgactctccgctctcttttcgataacttaatataaatggtgattagagtaaaaaaaaaataccaaacatatagagtaagcataattctcgtttgcatatagcgtttgtgctcttaattcatttagagaagaagacaaaaccataaaatgtaaagacacacgtaaatataaacacaaaggaacaatgatgtttaaaagaacctgcaatcttgagattttgcgacagaaggttatcggcgtgaagccgcaaagcctcccgcttgacatcgcgagttttgaaatcgaaaaatcgatttctcaaccaaaatattattcaatcaggagaatccattagaaagagagtctgatctctttcttaatgaatattttttcaggtgattctgttaaacaaaggcgtgccaagaaagaaagatttgtgtttttcttcaacaatgaatgaaagaaaatctcggaaacaaaatcagtccggaaattctagaaagattgaatccatctctatctctttctctatctctaactcatatggttattattagaaaagttttaaatgatagaaatctttgactataattatcactgctcttaattctattaaaacactttggattctcctgaaggttatgctaaatattgtagaagtagagactatatattatcgttagaggttagccgttattcttaggtttacaaagagttctttttttcaacggatgaaaatagttagagtccttaaattaggtttactaagtccagttatcaaatcgacttaacaagctgaaggaatataagaagagaaataggggaatggaggacaattggtataaacctaaatcagtttcttgagaaagaagcaaccagttcaagtgtgtggattgagtaataaaccctaactaatgctttttattaacaggccagctcagtaatattgactccaaaatattatgggttaatatatatatatagttatcaacaaataaaattgggtcataatatagatttttttttatcttaatatataattgtctttttatagtatatgtagtaatggatgttgtgatcttaatattttgcataagtagaaattcatcaaaatctttaataacaaaatcatgaaatgtagaattatgactttagtacctttacctctgtttataattttggaaaaagcatgaaatgaaaacacatgtttacatcttttagattatcgtgattaagaaagctcacatgtatatttttttataatattgtgatttaagaaagcaatgttgcataaatagaaaaagaaagctcagctcttattacaaacttaaaatttcttacaaatcatattaaacatgatcttatgtctcgtacaaaatgcaattgaatctagtaaagcaaatcacacgagattttctcaaagtagatagtttcatcttcaagatcaaatccgatgttgtacatttgaaatacggttgtccagatgatgttaagattgattcccggggtcatcatcacagctaaacagaaatactcttcttcgatttgttggaataagctggttagatccaaatctaaagagactcccttgtagaatgtcaatgttaccgtaggcaatgaagctagctcgcgttgaactgttccattgtaacactctagttggccatcactaaagttgtttagcttttcgtcaatgaagttgtcgatatgacttttgagctcaccgtacgattccccagccgagtttaatattgtggtccatgtgtcgatgattgtgtttcctttgatgggtgtcaagtgattaggaatagttattccattaacgctaatcatctcaaggtcgacatgataatgaccatacctcatatattagaatttatattttaatcacattttaagaaatgataatgattttaaacactaaacaaaataaacaatattaacaaaacagaaaaattaatttaaattattttgttataatctagattttaactcaatgaactatatattaatgctagtaattatttttttataatcaagattgccaatggcattaattcttatcaaataaatctttaagttatttttttattatcaaatattgatggagatatattagataagaaaatgctagtaatcaagaatattaattaattgataagaaatgataatgatcttaaaaactaaacaaaataaacaatattaacaaaaaataaataaattattttgttataatctagattttaactcaataaactgtatattaatgatagtaattattattttataatctagattggcattggcattaattcttatcaaaaaaatccttaagttatttttttttatcaaatattgatggagatatattagataagaaaatgttagtaatcaagaatattaattataagaaaaatgataatgatcttaaacactaaacaaaataaataatattaacaaaaaaaaattaaaattattttggtataatctagattttaactcattgaactgtatattaatgctagtaattaatttgttataatctagattgccattggcattaattcttatcaaataaatctttaagttagttttttttaatcaaatattgatggagatatattagataagaaaatgttagtaatcaggaatattaattaattgataagaattaatgccaacgacatttattgtaaataagttctaacttgaaaatttatttgataaaagtgttccaaaaatgtatatgtggatatgttcattaaaaatttatagatatttttttataagaattattatttgtatataaataatatatttttaatacataatttttatctaggataattcatgatttatgttctcatatttgttagtttaatattaaaattcagtatttgtttttatggtttggattttttagaggtaataaagatcaaaaacatgtattattttttatattttgttattttatttttaacttgtattatttagagattgacccgcgttataccggaggttgatttgttttgttagaaaattagatatttttattttgattaatattatttgtatatatataacatattcaagagatacatcaaacgcctatatttttattaaataaaaaatagtattttgattttaggatgatctatagatacatgctattgtttttttatgtattatactatgatacacctctttatgatttttataactaattgtttttttgaaaattttagtttttgttttagtgtttaaaattgtataattgtattttgattgttaattttaggatttcatccatggtatatcatcccatattaatatcgatccaaactcatcccaccatataacctcgtcctgtgaaattaaatattattttatcattttcttatgaagttcgaatatttataatattggaaacttcaaaaaagttttaatatggaccaaacttcataattgtatattgattgttacatatatgatttcacccgtaatcagtattaatatctttttaatatttataatatttaaactttttataaagttcataaaattttaaaatcattaatatttaaatttattttatagagtttaactttttaaaaagtgttaaaaattgtaatatttaaattttaataaagtttaaataaatataatattttaaaacttttaaacttgtagttatttaaaataaagaaccggagtaaaccgaacaacacttttaattttggatgtttgatatatcaaggttctttctcatttgtattcagaaacactttggtcttttttatagtatgacttttaacgatttcccaattttttaagcaatgtgggatctttaaaacttatttgttttcatcgatggagtattatatgtctgttttaaaaaatttgaatttcatcagatgcaaaaaaatctaatattttattaaatatatgtattttatatataaagtaaaaaaactatatataaaaacaaaaaattatatatttataatgttgatatatagatttaggaaattagctttaatcgaatatagttcaataaagaaagattcaattaaggataaaaatttaggaaagagttaattcaactaattaatacaattcaactaattgtaagtttttagttataaagtatttgattgaaattaaatttgtaaggactaatattgaaaatagtacataggtgaaggatttttgggcaaaaaacctacgaaaaatataaataagttctactagggttaattatttcgagaattatacagccagttgattcttgcttagaaattttgagcataactcaaaacgagtttcatgaattcgtactaaataattgagtatatcagtgaacaacgaatactattcttttgaccttccacatgaaaattatagtcaaaattcaaattgtaatgtattaatgtaaattattttcactcgaccttggatttgactggtcaacgtcaaatgactcatattcatgcactttgatttatggcttctgtcaatgtaatgactcatgatgatgcgtgtgtgaccgattgagatctttaggtgatggaaatccaatctacgctctagtggtaagaagagccctcgaaacttcatgagaatatattaaaaatgaaattagctatattgatacaattctttcacgctatacataaaatacactttctgactgccaattatgatacagtcaaatagaacacatatcctaattgatgagccaaaaaacttatgtatgcataattacatgcatgcatgatacattaatgggtttcattagtaacacaaaactatataaagtttttagctgttagctgaatctgtaagttttttcgaaatagtgcataattgtaagaaaaaactgtacaaaaaaactgtacataagaactgaaagtaaaattttaaataatttttttgataaatttttttgattaataactgttaaaattatacaaaatatattgttttgataataggttaccatgcaaagcaattgaatttaaattagaagagtttgttattttagttgaagatcgatatcattgataatatttataaattttgactttcgtttacgatcgatatcagattgcttaaaaatgttagattattgactttcgtttaagtattatattgataggtttcttcagttcgtttcaacaaaataagttacaaaagtttatacaaatattaaaatatatttgaactaaatttgattttaatatgaatttcagttctagctatgttcgatttggttgactggtgtacaaaaaaagatatgttggattgtgtagacatattttttggttcgatcggttttagagtgtatatattaattgtttcaaattcggtatgatttatataattctgtatatatgtgtaaaccaatgtatccgctaattatacatgtgtatacatttagtatcatgattcatgtatcgatatacattattacacagtcgacattactgccatgcccatgcaacgtcaggaatgtaaataatgtatatttacttgacttcataggcatgtctattatatacacacactagaatagtagctagctagatacatctaagcgtggtgaaattttcattggcccttttgtcttttaaatattccgaaaataagtttctcaaaggccataatattgaccaagctggtctattttaaaattagttaaacaatgaatagcaagtatcatttaggtcgccatctaaacttacgttgctcatataatcaacattaaacatatcaaacagttgtaaaatgcaacaagatatttataagttactctcatttaatattcaaaagtacatgtagtattattatatgcatacagtcttcgatgaacttccatgagttcttggaaattctatccacggtcgggatttttaatagttggggaccaaatttgaaacgatatctacatatacatttttgcaactattttgtgaaataaatcttgtagttgagatttatttacaatggctgccactagattttcattgcttttctccataactataacaattcgattataaccatcaaactgcagaaatatttgatagcatttaattactacaaaattacaaaatatttagacaataattcataaacatatcataaataagatcaatattaataaaactaatgtttttttacgggacaggttggcgggacgggtttggcagaacgttacttaataacaattgtaaactataaaataaaagtattttatagatagatataatttgtaaacttttatgtatattaactttaaaaaataaattgttcccgcggtgtaccgcggattaaaatctaataatccttaaaaggacaaaggatttcaaaataataattcttattcatctcttaaaaaatacttctcatccctatctagctcgttatacttcaatcaagaatcataaactaatataaaatatcttgaccttgtcaaataatcaataatgtcgacatgcatgtgttacatatataatttccatacctaaatccaatttccttgcattagtttatattccaattatagggactagttttcgttgtaggcatagcaaagatagttttaacagtgctgcaaaaaaatggtaatcctttgataactttagtcagtggtattttaaaattttgaataatggtctagaataaatttattaaaacaaaccaactttttattcattgtagaatatcaaaacaaaaaatttgtttacgacaaaacaatttcattgaatacacacctttggaatatcaaaattttgcacattaattggagactcatcaaccgtgggagctgccgtagaagtatttctctactccatacagaagtcaaagctctactttgggcgatgaagtgtatgattggcaccgacaacaaaaaagtagtattttttacagactgttcagacctggtgaagatggtgtattctctaaccgaatgaccagtgtttttaacttatttggagaaattccagaccgataaggaagaattcacaagatttttcttatttttaatttctcgtactgcaaatgttaaagcggacaaattgacacgaaaaattcataccaaatcgcttcatatcactttttgtaaataatttttctaagaattagctcttttgaactctaaaaaaaatctcatgacaaaaagaaaagagcaaatatcaaaattttattaaatgtttttgggtcaagtaaatatatacaacaaaagaaaacccgaagttttcaagtctctagctatgggtgaaaaaacaaattaacgaaacaatatatatatatatatatatatatatatcaattaaataaatttcagtttttcactcatgacctttgggtttatatatatgcaaaccatgcaaagactttaaactgggacaaatatggctatatatatgtaagggcaaaaaaacacaaaagagagacgacaatttagagaaaacaaattaatgttaacctcaaggacatggatcatctcttcaggcttagtcggagccatatcactgatgcttcgatcggtttttaacttctccttcaccggagctcgcttccttctccctactaatttacaccctattttcatcatcaacggcatcatctttgccctcgcagcctctacttcactcttcggaaacggaccagactctccggccacaaaccatcaccatgatgatgatacgtatgattacgaacaggaccatcatcacgaccatgatcgtgaccgttcttctaataactcatccacttcttcgtttgatcaaaacaataataaggttcacgagaaagaaaattttccagtgagatcagagagtggaggatcttatggggtttcttctccggaggttcgtttttttccaacggcgccggagaagcccgtcggtctccgacgtccacctactgttcctgtaaagacttttccacaaggtatctatctattacgtgccgtctcaaaatctttgtagagtcctcagcaaaatcctttattaaaattatattgatattttaatttatatgtatatccacaattttcttatagagaattatttttgaatcgtatttttgttccaaagtttcagtttttgttttttttaatttttttggtcaaactttaaagatataacccaaacttgtattgaaagtggaattttaagagatttgtatagaatttataaatcctatgttatttaaacataaattttaaaaagtttcataaaattcagtgttattgaactaataatttcaaaatccacctgaaaatccactgttattgaaaacaatttgtggatttgaatttaatgattttggaggatttgagaggattttcttagttaaaaatacagaaatccaaatctcatagttttgggtgagatttgaatggattttacaaaaatcatatgaacttctcctagactaaaatcatcaaaatcatttaaaaactcaagaaaactcaaatcactttaaattctaatttgaatacaccctcctttatttgttaaagatttagaaaaacataaaccaaactgaaaatcttgtaggaaaacaaaataacaataagaagattataaaaaattctataaataatacttcctctgttctgtaatacttgataatctagaaaaccatatatatgaagaaaacatattaaaagctgattctaaatgtatttttttttgtgatttacatttttttataattctacatcaattatatgttatatttaattatatataaaatattatataaaaaaaatcaatattttagaaacaatattttttctagaaaatcaaataataaggaacagatagattccagtatcattttgtccaacgaaaagtatgagacttagagaaataaaaaggataagttgagttgtgtgattttcgttatgaacaatgaatattacgtttaattactttgatttagttccagtaaaaactccaacttcgtatatatataactatatcatcagacaatacatcgggggacgagagcgagaccatggaggagatgtgggagagagtcaaagccgaaaagcaaccaaagaaacctaactcgttgcaagaccacgtcatatccaggggagacacaaaaatgtcaacatcttcatggccgttgccgtcacgttcaccgtcacgagcgaggaggcctactccttcgttgtcttcgctatcaccgtcatcgtcgcgagcaaggaggcctccttcatctcccgcgcggccgggaaagaagttgatggagaggattccgtcgtgggtgaagttgaaaaaagagttatcaatgggaagagaggagctcaattcacgagtggaagccttcattacaaaattcaaggatgagatgaagttgcaaaggttggagtctgtaagacgttacaagtctttccgtggtcacaacgatgaaaagtaagaaagttgatataattatgtaacggagacttgtcttcattttgtatcatatatggttagatgtgtatgtctttagatttaattatgtaaatcttgtgaccaaatctgcatattactacattcatcttgattttacattttttacttgatcccattatccaaagtgagtatgtatctcaatctataatcatattggaagttcaagattgatttgaattagttccaatccacgtgtgttcacaatgatattgggcctaaggttaatggcgacctgatcaccttccaaattaatgcttcattaaccaaacacatacactaaaatgaactaaataatgagtttgagcataaaagaactattatgttgataacatttaacatataacttctatattgatgactaaaaagagaaggaaataaaaacatctaactttttaagtcaaaactcagtggaaatttgtaagttatatgcctttggtttcaattttgctatgacatgtaaaataatgcaacaacaacccaacccgacccgtaaaataaccgcaatgataatcccaaataggcaaatctattgctatgttgacacgtaaattagcaacgacttaccgtttttttggaatgaccaaattcatacctatgttattttgttggaaagtttagaattaatttaattaacaacaaattcttttcaatgaattaattattagggttcacaactaaagcaagcccaagcccaatgtaatgtccatgtaactagggttttagcaaattagaaaattcatatatatagttatttaatgagaattatgattgtaactttgagagttggaaacaactctcctccttcatcttataaaatatcaatttaaaatcgttttgttattggtgacaagcctaaagctccttccattctctgttctttacattgatcttggtcttgctttagttgtaatcaacttacgacgaattaaacatgtgtttttgtattgagaaagctacatctaaactaaaattcacagaaaaaactgtattgaaaaactaacttagattggtcgttttaacaagcaaagacatcaaggttgtaaggaaagcatggaggatgactgttcaatgtgtcatccaatatcctctttgcctcatacttcatccaacgattaattttttcttctagtttcctttatgatgctttccactatggatatgtctatttgcatcattttttcgtagaaacagtaccaccacatccttttatctctcttaattcagtatctacaagatacataaagagtaatcataaaacatattaaacaaggttacaaactcaaaaacatgatgaacatagcaaatgctgcttaaagaaaaactttctaactattttagaatgctaaatattaatatcaatggaaatcatcactggaaaattgtcgtcggagtcaccaacgtcggagtcactaccaccacctcaatctttggccatttttacttaccccttttcttagtttcttattttttcttatttcaattaaattatcaaaaatattacaaatcaccctcgtgggaatgcagattattattttttaatatcacaaacaacaaatatatgattgcaactattatcctcaaaaggaacaaattagattataaattttaaatagtttcaacattagaatattcaagaaaaaggctgaatctaaatttgaacatttatactatagaaaagtcgaggttatttgcttctcaaagcgtctacataagatttaaaacaaccaatcgagattaaccatctcgctaattaacatttatgaaattattcttatttttttatttttttagatttttgtaaaataggaaaaaccaatatatgaaataaaaaaaagtatttgaaaatatggaaagttttctaaacattttgttaccaaataatataaaatgtatcaacatgtaaatttctattttattaaatttataaacgaaaataaataatttattattagtctctctaaatttattagtatttcatctttagttacaatagcaaattataataactatctcattaaatgtattttcaaatttctcttccttctgatctgcaaaactttcatatctttaaaataacaatcttgtgtagtctttgttttaagttacaaatttaacatgttctgtgattaagaaaccaatatctaaaattatttctatgagtcggaacaaaaaacaaactaaatttataatttaaaatagctggaaaaccaaatgacggtttctttaatcaaaaaacatgagcagcttgatatgtttcgctataggctttaatcgtttcatccatttatctctattctttttttgtgaatggttttggaacctccatccaaaccatcttcctcctcatattcatcagcatgatcgatagctcaaaagatctttttataattgttgttgtgtatggagttgaggatttggttatgagcaatcgtcttcacgatattaacttttgttcaatcattcattggccatgaaaacattgttcgtgtgaattttttgctgactcgttacaatcacaatctacgcatatcatctctttatatttgtgatgaatttgaataatcagtctttgctttagttcagaatctcattcgatacgcttgttaaacaaatgctaatcgaaacaagtaagcaaaccaaaaaggtgtggacaagtttttcgtatggttgattctagcgacgtagggaaagcggcaatttggagtgaatatgtcttacttccatccattcatggcagtaatattatgttctaattgactagttgatacccttaaaatatgtataatctctaataagctttcttctttatttctctacataatgaatgaatttcatgatgttcacattgctaagcatgttttaggtgatatgatttgcacataaaattttttcatatgcatatgttttgctcatgttttgcatagttatgttatgcataatggacgcatctatatatttataatttacaattcattatcatgtaaaagataagtttaaaccatgattttttttgtaagaaatgttttaccttttctcttcctagtgattttcaaaacttccatatctttttttttaaaaaaaatcttgtgtagtttatatttaaatttacaaattgaaattgttatgtgattaagaaatcaatatctaaaattatttctatgagtcggaacaaagaataaattaaatttgtaatttaaaataggtggaaaaccatatgacggtttctttaatcaaagaacatgagcagcttgatatggtttcgctataggctttcatcgtttcatccatttagctctattctttttttgtgaatggttttggaacctccatccaaaccatcttcctcctcatattcatcagcatgaccgatagcttaaaagatcgttttataattgttgttgtgtatggagttgaggttttggttatgagggtaatcgccttcacgacattaacttttgttcaatcattcattggccatgagaacattgttcgtgtgaactttttgctgcctcgttacaatctcaatttacacacatcatctctttatctttgtggtgaatttgaataatcagtatttgttttaatttagaatctcatttgatatgtttgttaaaacaaatgctactaaaaaaaagtaagaaaaccaaaaggtgtggacaagttttccatatggttgattctagcgacgtaaggaaatgcggtaattttgagtgaatatgccttacttcaattcattcatggcagtatgttatgttctaatagactagttgatacccttaaaatatgtataatctctaataagtttttttctttatttctctatataatgaattaatttcatgatattcacattggtaaacatgttttaggtgatgtgatttgcacataaaggttttttcatatgtatatgttttgctcatgttttgcatagttatgttatacataataaataattcattatcatgtaaaagataaaaccatgattttttttgtaagaaaggttttactttttctcttccttgtgattttcaaaacttccaatctattataaaaaaaaacttgtgtaggttttattttaatttacaaatttaacttgttctttgattagaaaccaatttctaaaatctatcttattatataaagtacagttttgaaggttagtaactcacgagatcatgacaagtctctattttagcgattttagattttgatacgtgtaaaacttaatattaaaatttttgaaattagaaaaagattgaaaaaaattagaaattttaaacaagaacatacatataagatcatagtagcaagttctcttgagaaatatatatatatatatatatatatatatatatatatgcaaatataattaaaattggttatgtcaaacgacaattggatgaacctatggataatgagataacttcatacgtggttctttttttgaacttcggttgtatatacttcggtttgatggtatctaaccagttaaaagtatgacgatttgtgttgaaattgtggaaatagttgttctttttaaaaatatcaatttcaataaaaagaaggaaattgacaaggcgtaagaaatgtaataaatttaattaatgaaaagttttttgtattacgaacaaattgataccaaaatttaggtcagaaagagggttgatttccatctaaaatgatggagaaagagaaactcggttgatagcataacacaaacttggattctcaaatatgacaaagaaaagtgagaaaacagttatgacaagacttttttatggcaacgtttggttcatatgtagctagacttgatgacgaggtgtctggtattactgttttgaggttgaatggtgggatatagatttaaacgtctttttgtgtgtaatttatctaagctttttcaattggttcgagaagatttattctaaagttttagatcttatcagatatgtggagaaaaaaaccgaacatccgaataaactcgaaatgtctgaaatttggtagagtattccggagacatggaactaagggatcgaatttcgagttcataggaataaaccaagtcgtttcgatatttaattcatatgcttatggaattaagtttggttaaggttattaagtttaaatttaatttttttacagaaaagaagatgaaaaaaatgagaaagagtgaggaacataacgaagaagaggaaaatgaagagtataacgaagaaacggataatgaaagtaataataacaacgatcataagaaaatcgacaataaagatgacgaaaaaaatatgaaaagtaagaaacgatgaatgtgaaaagaaatacgaagatggtattggcatcccattaaatatgatataagattatttataattcttttgatctaatttgactcgtacacactattaagttttataatttctaatatggtgtatttgaaatgaaatttttattttagaaataatttaaaaactctaaacaattgtatataattttcaccaaaatatattaaaacaatatctacggatagcgtgggttcaatacctaatatataaaaaattaaaacaaaaaaatttatctacaaccaaaatttgtattatagtattatattttatcagctaaaccggtatcaaatcatttaaattagatatcttttatttttgtccacaaaaaacaaaggtatgtattataatgaatattaatatttataaatagaccgaaataaaaaaccaaaatctaacttcatagatagttcatacttcataccaaacaaaaaattacaatatttaaataaaaagtaaattcgagtttcgaattgattatgttggtttgattcggattagatcggaaaatcaatttttggtagtagtatttaatagacccgatctgatccggtagtaccggttcgaccaaccggttcaatatttattagattaaaaccaattgtcatcttcttcttcaccaatcctctttctcaattcaacttctccgatcagatttttttttgctttcaccgttcataacttctcaggtcagttttcttcctctttcactttcaaattcgtatggtttacgaatcttcttcgctattttttattcagatattcccctccatatgttagatctcgaatttttctcgaatctcccataatttacttgaatttagggtttttgaatcgacggctcatcactaagttttgcttaactttgttgatccgtgtttttgttcatcgttttcatacgcaatcatctcttgacagaccttcgtgtaagtaacatctccatttgttgtctcatctttgaagaaatctgggattattgcttctagtgagtgagatataggaatctagtgaaaaattacttagcttcttcatagcttttgttccatgttgtctgctaaatgtgagattctattactgacttgtgagattagagttttaacttggctctgttggatgaagaaatctgattgctttaagcaagttatgggaagcttagtgaagaaattagcttcttgataggttagagatacttcgattctgttttttaattttcttcttagtttgagcttttgtggtaaactctcaaactcatattactgtgtttgggggtattagaattgagtctgttggatgaagaaagctgggattttgattacttctaatagatttagaaagctttagtgaagaactgttagcctcttgataggttatgagtttctttggacaattctagttgcttttcatttcttctcgatttgaagttttcttctattgagatattaggatcttgactttggtctgtgtggtcattgatacagaaaggaagagcttgtgcgtgtaccgttctcttctccgtagattgacttgctctaatgatggaggtcaaattatggaacgacaaacgcgaaagagagatgtatgagaattttgcagagctttttgcaatcatcaaagccacagagaagctagagaaagcttatataagagacctaatcaatccttcagagtacgaatctgaatgccagaaactcattgtccacttcaaaactttatccgctacactcaaagacacggtgccaaacattgaaagatttgcagacacatacaaaatggactgtccagctgctctataccgcctggtgacatcaggtcttcctgccacagtggaacaccgagctaccgttgcagcatctacgtcgaactctgcatccattgttgctgaatgtgtacagaatttcatcacttcaatggattctttgaaactaaacatggtggctgtcgatcaggtttatcctctcttgtctgatctatctgcttctctcaacaaactgagtattctaccgcccgatttcgaagggaagacgaagatgaaagaatggctttcgaggttgtctaagatgggagcagccgatgagcttacggaacaacagtcaaggcaacttcactttgatctcgagtcatcatacaactctttcatggcagctttgcctaaagctggtaattaagatcaatgtaggttacgtttcttgtttttgtttttgtgtaaaagtctttggtttagtctggtttagtggtaattccaagagaattttacacgtttgaggagttgaatgtgcttatgtgtaccatattttggttatatgaaagttttatctaaaccaaattactattgattcattactctcacgggactatatataattgcagatttgtttgagtgaattaagatactgtggtggactatctaacttcgaggtcgttgtgctaagttcaaacaaaaagagagatagttaaaaaatgtgaaattacatggatacaaagttcagtaaaatctctataaatgagtaatgtaaggaccgtgaaattttattaatttgaagaggtattaatatatcgataaattaatattatatatatagagatttttataatttagtaactttttaattatagaaaatattgttctaaaaccaattacaagtaaaaaataattataatatcttgaaaataacatcaaaatttttttgatacagtaaaatattagaactaaatttaaataagaacaaatatgaatttaagcaaaaaaaaatattataaatatatttcaaataaatttcttacatataatttatatatataattgatacatttatataattattaacttatgatattgatggaccatatatatacataggactttcaaaaaaaaatattatcttaatttttttttgttaatttatatcttcaaattgtaggtgacattgaaggtacaacatcgatagcaaccagctctcgagtatgagaaaaagttgtttagattttttttactacttttgtatttctgtttcaaattagaaactttgatgaaactctcttttgtataatcttttaaattattaatgtttgagtggaatttgggtttataaatttgttagaaactttgatgaaagtaaagaattaaatcaattaaggataacaaataaagttgtttatacaaaatataaaatacatataacattgaatatatatatataatacaaacaataaatacaatttaaatatatctatataaattttgggttcccaaaggttgttctagaacacatggatttttctaagttttacccacaaataccaaaactcattcgggttttttgaatctgggtttttttatgggcatgcttgttttgggtttgtcctgagctgagttttttttacccaccacaacatccctaatcacaagtcattattttagatattttaagtttgagagctaatctattagttataagtactggaaatcaattacaatccaattgagaagtataaaattcattttcaatgggtaaaaccatcattggataattttattttgaaacctaaatagattaagaacatttagtttaaaaacttatgtaacatcttgtacatgatttgatttttttacatatatttggtctaaaacatgtaaaaaaaaaaaactattcaaagaatctatctctctattagttcaaatcattgcaaaatatggttacttaacatattaatcattctatttaatcaaattgcaattctaaaatcacgagtagtcgctaaagacaggcaaagtagtcgtaaagcaccattcccttgtgacgtttttttatgagtcacaacccaatatttatgatttctgaactttaagatctaaatacattagtaataagtattttgaatattccagggtccaattttgaagcatatcattcattttaagaggtaaaataatcatttagtcttaaacatgttcaattaaaatgttgtgaaataatctatcaatgtattattgtcaaatcaatgcaaaaatggttaattgacatatgaataattctttttgatcaaattgcaaattttaaattccgtggagtccttaatgagaggcaaagtagtaataaatttaagactcttttgcgactatagtgaaattttaagaaaaaagaatttgtatttttacgttgcaaaattatcgtaagtgagtcgctaattattgaccattctccgacttaatgcaagtgtcgtacattggcgacaaaattgcgtctataagtttgttagtcgttaagtagtcacaacctaataacaaaaacatcgtaaatatgtacgaccatgataaaagtcacaaaaaatagtccttaaatacacgtgatatcgccactagtaagacttttttattcaccgtctaacccaaaaacaaatatggaagatttataaataagctgatcattttttttttcttcttccttaattcatttttttttcttatttcctaatttataattcatttataaatatgaaatatttccacactttttcaaaaactttaaaatttaactgttattcccacgtggagaatcaagtaatcgccgtcatccttcattttaacggaatccaatgagtacactgcacaagtcaaccttcctcactaagttacaaaatcttaccgttcaatatccacgtgtcgcacgatcataatcaaaacacaccgattaaaccgtgatctttatttcacatgattctccacttcaccgtatataaagaagaaaaagaagccgtgttaaaacccgacactaccctttttaaaagccagccgaaaacgaccgaccgaccacgatcaccacttcatcatttaaccaatcaaataacgccacgtgttatttgctttttttttcttcttcttcttccttaattttttttttcttgtttcctaatttataattcatatcaaatcttcagtctcagattctctctccccaaaaaacgattcacataatctttttgttttctacttctgttatcttctcttggattttgctttatacttccattagcttctgaaaattcagtttaagttatggcgtatttgagtgatggatttgaaatgaagtcgactcgtgagtatgagagattagggttagggtttgtgaggtttactagaggattagggaggaaaaggattctcatatctaaacgagctccggaaaatgattcgccgccggtgaagagaccaagtcatgaaacgacggaatcttgtaggtctctgcttgaaactctgcatcaagatattttggtaagttcatttattaataaatctcttttttctccttaattgtgattagttttggggatttgattttgatctgataagcagattcgagtactttgtcatgtggatcacgaggacctagccacactaaaacgtgtatctaaaacaataagaaaagctgtaagttttttttcaagattttgaatcaagaaaatgatcgatcattgaattctttctaattaagcaataataatttaatgttttttttaattgaattttatgattttttttaggtaattgaagcaaagaagtcgcattttgattatagcacacctaaaaagagattgccatttcgagacgcaatactaatccttgattcaaattcgaattccagtagtcaagatgatgaaatggagcctcctaatgcaccaattcgaaggaggtttattaatcgagaatcggatttgtcgaagatctctatggtattgtttaaatgaagaagaaaggtaaaaaaaaagaatcagctaattgtgcagaagatgaggaaagaacaagacatagaagagtttgcttttgcttcaattctttatcattgaagctttttattatatttactgaccatgtgaatataaccaattatttgcagactttggaaggttatttattatttgtgaataatttatttgttttgtgatcagagtatcctaagtattgattttgtccttttcaattaaatattgttaagattcttttttaatactgctatttcttgactttcttctcctatttgtttttaatgcaagtgaatgaatctaaaagtattgcttatatgaacaaatcaagagtaataaaattggtcaaataattaagaagttaaaaatcaactcttgtacatattgggtttttcattttaaatgagtaaaaatacaatgtaatgacaatttattaaatgtatattgttgcaaaatggacatatcggggatgcaaaaaagtacggtacggttctaataataacaaacatatataatttcgttactatccgagttgttttgcactgtatgaaacagtttttattcaagatcattatgttttctttatcaacccgtcacatttcaacataacaagatcctgctaataaaaatcatgtgaacagattttatagcattgttacgtttgtaagtcaaccatgtttcaacataccatgttttatcgacatcacacaccgaataaacaacttacatgttactttctttttaatctaatgtaagtaaacatattgaatgaatctaaaaaagtacttatatatgaataaatcaattgtgtgtcagattaaattattatgcagactttatgtcatataatgcatattcactccgatcaacagctcaaaatggattgttttttatttaatacattgctctccacatgtggttgtagaaagtaaagaagagaaaagagaggcaaattctataaattagctaaaaagtagcttcacttcacgaaagttctctcttatatatattacaaacctcaccgacagctattttttgttatctggaaagttgtaaataatcgaccccatgatccattctttttttcatgttaaaaaaatgcaactaaaggggctttaacccgaactacgtggatcgaacctaaaccatacaatcttgtaaatttaaagttttgatcatttcgtgtggaggttcaaacaaactgatgacacatggtcggtcgaaaatagttctaacgtctcatgtggtttttacatttttgtggcatctttatcttatacatccaaattccaatgttggtcaccgatcatctgcatttgtctttacgtcttatgacccaaaaatggtcaatcatagaaacatagtcaaccaactccttgccgttgagcaactcaaactcatctttttcgtgccggcgaaaacctcggttatgaaattattttcaacgtcacctcatctttttaccgtgtccaatttgttttccattgatttgtttatggaagatcatttgactagtcttaacctcacatgtttcagaatgctcaatagtatttgttttaaagctctcattgatttaccgtcgtttcaccttatctatcatgttttgatatgggggaatgtctcttttatttgcattttaaactttataatctttgtgttattttttatatatttggtttgatttaaatgaataaaaacaagtctttatctaaacacaaaaggacccaaaaatggtcaaatttgggtaggtctaagagtgggttgtcaatctccaactaaccatgttttgatgtcccaacaagctcttgccttcagatttgctagtcctaattattctttgaaattataattcataataactaatgacctaccaacttcatcatcttccactaatctaccgagtaacatgttaggatttagccaaatgtcatttccttagttttggttacaaccacaataaaaattattatagtaccctatatatatattatcattcaaccgtagaacatgcacaacgttgacaaaataccccaaaaatgtcatttcctttgttttactcttattttctaaacaggtgattttggattaaaggttacttaattttggattttattataatcgtcatgtaaattttctaatggtcaagagaagaagacttcaacgagaaacgacttttttggcattgaccaacaaaaaagtgccactaaactaccatcatgggagtaattacaaaagctttgcgtagtcaaacattcggacatcaaagacaaaaagtacacaatataacaattttaggtggaaaaaacaaccaaaaacaaaaatttgacgcgttttcttgttaacaggagtattggttaatacttaatagctttaactatgcattgtaaaaataaatcataaaaggatcaatgacgatcttgattgtttagaaaaaaaaattatttcaaaaagatttattttttaggttttcaatgcaatagttattagttataattgataaattgtaaactttaatacaaattattgaatatcattggtttagagttattgaaaattgtaaatcacaaagaacaatacatttaaaaacaacatttaatatgttttcttaatatttgtgtttttcctaaaagattaaacaaaaaagaacagaaagaatatgaaataagaaaaaatgcactagctttttttgtttgagttaaaaaggactatatttattaagaggtaaatagtatatcatttttacatgttttaacgctatgtaaacgtgattaagttacttgttatcaaataatcaaaattttatgattttcatgtttttgaaaaatgatattgccgtatactgtgaatgtgtaaaaatataggtgaaaaaaacaaacgccaacaatctattatgcttaataatgactcatatataagaatagtttgctcatttcttatgctttgttaattgttgttgtatgctaagagaggattgatgtttctagtgatgtgctaggaatgttctcatgtataggatgtatcggatcttgaggttaagaaatagagattcacatttccattcttaacacaacataaataaggattaaggctaatgaaaaagagttcacatattacacattttactaattaatcatggtgattagataaaggtaacaactaaaagtcattttaaccgcactcaatattacgagcttgttagaacactgtaacacaagtgttctcttccagtttatcaatggaggaaactggtaaaatcccatggacgatcttcttctctcatcctctgttctcttgtttcatttcactctacactatatttcttctttatttccctcaagattctcttcgaattcttatttcccatgtccctctcctcatcggagctttcttaatctcctgcctccatctcgggtcgacccggaaatccattgcccgacccggaagcaatgaggattcgataggacctgaactcaaaacgggtctcggtttaaacccggattttatggaatggaactttaaattgggagctccattggaagttattcacaaagaagaagaagaacagtcgatgacgggtgtaaaagatccgacccggttcgtgatgatcaagaggtttccatcgttatcgatgtttaacccggaatctgattccgaattggaccgcgatttcccggttatgagtgaaaatgatccaacccggttcgtgaggctggaaaggtcaattaaaccggaatctgatatggattacgactccgaattggacaacaatttggttattgatgtaaaagatcgaactcggttcgtgaaggtggagatattcccatcgttgtcaatctttaaaccggattcgaattccggttcgccggagaaattgcgttgtatatacgaaatcaaaacggaaacgctttttgtagttttatattcctggagaacaatattctaacaacttgttttggcagcaatattctgatttctgagtataatttgattcgtcaagtaaaatctaattttataattctcaacaaacaaactcgaatttgatttctctaatgtgtaatgtcgtcacgatttacgtataacatattaaaagttgtcgacaaagaaaatgaaatacatttccaccaaatataataagtaacaacatggtcagattcagagaggacgatctggcttggccaccaagattgtttgacaagtatttatttaactactatactttctcttccacaatattaataatgttttaaatgtcattattaatacgtgacgaaactgtagctctgaaataaatatattaacaaaacaaataaatattctcaaccaatcataacctcgtatttgtttttgtttccatttaaattttattttgactcgacttttacacgcatgccacgtggtcaaccaaaacgtatgacaaactctacttctccaccgtcacaatcatctcctggccccctctagatctctctctcttttcctccttagattaaaatttctccaggtttcttggcgttactgtgtgaaaaattcttcttcttcttcttctcagcgattgaatcgaaccaagagcgaaaatgagaaatttcagtgtcttcgagagattctctaaagcttttaaagatcatccttctctcaccaggattctcgtcgtctccacgatcaggtcttcatcttcttcaaaaacgattctcgtagctctctgtttttttcttgtttctctgttgttgaaacctttcaattctctacctggaaacgtacgaacaacaaattctccagggaaaactatctgttgaatagattctttaggttgtatcatttacgcaacacttgcttttgttaaattctgaatctcccagtttatttcaggaagaacgcgtttcataatctgattcgatgaaactcaatcatctggattttgcaaatttcgttttactgtttttgcttatatgtcctggatcttagagtactggatctctgattatttgattgtgtagtttttaaggttttgttgtgatctgtgttgactgatgtgagattctgtgtattgttatagtggtggtggacttatagcgtattctgaggcaaacgcatcttatggagcaaatggtggtgctgttgttgaaactggaaccaagaagaagaaggtggtgctgctcggaactggatgggctggaactagtttcttgaagaatttgaacaattctcaatatgaggttcagattatatcgcctcggaactactttgctttcactcctttactacctagtgttacttgtggaactgttgaagctcgtagtgttgttgagcctattcgaaacattggaagaaaggtaattctgctgtaaatatggctaactctaaatggaaattttggttgaaaaaatagctaatgcacattcgttttcctgccttgacaaatagaagaatgttgatacttcttacttggaggcagaatgtttcaaaattgatccagctagcaagaaggtttactgccgatccaaacaaggccttagttcaaatggaaagaaagaattttctgttgactatgactaccttgtaattgctactggagctcagtctaacacctttaacatacccggagtggaggagaactgtcattttctgaaagtatgttctcttggctcttaattccttttcctgctctacttggtatgcattgatagtttaaagctgaaaagcatgtgaaagtagagtgatcatttgtaggatgttaactttctgtggctttaattggtttcattatgtgcttataggaggttgaagatgctcagagaatccgtaaaactgtaattgattcctttgagaaggcaagtctaccagaactaagcgatgaagagagaaagagaatcctgcattttgtggttgttggtggtgggccaacaggtgttgagtttgccgctgagctacatgattttgttactgaggatctagtcagtctctatcctagagccaagggttcagtgcgaatcacgcttctggaggccgcagaccacatcctgaccatgtgaaatttctttactctaaaatttttgatcaatcgtctccctataatttttggtcagacgattagaagtttcaggtttccataaaaacctcgttactaattcatggaaagcttttctttcacaggtttgacaagagaatcactgagtttgccgaagaaaagtttagcagagatggaattgatgtgaaacttggctcgatggtaactaaagtgaatgagaaagatatatctgctaaaaccaaaggaggagaggtttcctcgattccttatggaatgattgtctggtcaactggtattggaactcgtcctgtgataaaagattttatgaaacaaattggtcaggtaaagtaatgcgctttagatttaaactcacactttacaattttcaacatctcctagcaaacaaatttcaacaactcgctctaagaaattgtctttgtaatttcagggtaatagacgagctctggcaactgatgaatggcttcgcgtagaaggaactgataatatatatgcccttggtgattgcgcaaccattaaccagcgcaaagtcatggtaatttgacgcttctattgcttcccaaactctggaataatgtttttggattataaaacaaaattattagtggtttcttgttgcaggaagatgtttctgctatttttagcaaagcagacaaagacaagtctgggacactgactctcaaagagttccaagaagcaatggatgacatttgtgttagataccctcaagtggagctctacttgaagagtaaacgtatgcgtggcattgcagatcttcttaaagaagccgaaactgatgatgtatctaagaataacattgaactgaagatcgaagagttcaaatcggctctatctcaggttgactcacaagtgaagtttcttccagctactgcacaggtaattcggtggaagtttaggaatttaagtcttcgttcatcttcaataaatctcatttttgctggattcttatcaattagttatatgtggatttttaaggttgctgcgcagcaaggtgcttacctagctaaatgctttgaccgtatggaagagtgtgagaagagtccagaaggtcccattaggatgagaggagaaggtcgtcaccgtttccgccccttcaggttagtcctccctaaaaatttgaaccaatatctttgtcttattgttgattaaaccaaaccaaaactgtgacgtagtagatatagtgtgtaagcattgatccttaatgttacatagtttttgagaatatggaagttgagaggaatttccaaaactctgtctcaagatactactgagtcatgtgcattggaccataagggtgtaggaaagatggagttaattccttatattattaggtaagaatgaaaaagataaagaggacgttaggaagcacatttagtgagtttatgtagtttaatcctaattttgatttggttggggttcagattatatatatatatatatatatatatatatatatatatatatattttttgttggtttagaaccaacttgaaaccgtcttgatccgtttggtacaagtttaatttgaaggattttaaaagagatcaaagtttttgactgccgaaattgtggtttgaaggtcctttggatatagaaacacaataaaaaaattgtgaaatccggttttggtgtttggactcaaataatatttgggtatggtttggtatggtgacaggtataggcatctgggacaatttgcaccactgggaggggagcaaacggcagcacaacttccaggagattgggtttctattggacacagcagccagtggctctggtactccgtctacgccaggttaaaatgcttccttgttctgaaaattttaaaatgaaatccacaaaggaatgttttcaatttttacttaaggtagaaaatgtttggatttggaacagtaagcaagtgagctggcgtacgagagtgcttgtggtttcagattggatgaggcgtttcatctttggtagagattccagtagcatctgattttcaacctccaaggctccaatacacatatctctctctctcacgagttacactaactttctcatgaggaaaaagttttgattcactttaaaaaatggaaatccaaatcggcttttatattttgtaataaaataatgaccacaagtaacgaggagagattgcctcgtttcgttggccatatcgttgctgatcccgaggattgtactctctgtttttctctgcaaatattcttcaggttggctttttacctttatatcctctttttttgtaagctttttcctcaaattttgtttagtacgatgactaaaactgagttttgttatttcttgctctctgtttttctccttcaatatcatggtctttttttcttttcaaaatattggtatttttaatatcgtggattagcttaaaatggttttaacttgttatttattaaagatatggagtgactaaaaaattttcaattgttttatttatattaaagtggctaggaaaacagagaaattacataatcaattgttgaaaagttgaatttgaaaaagtgaatctagaataagacttgtttttttaagtgtcgtcaacatctgtgacgctgataatatcagcgaaaccaactttcttgcgaagccggacaactaaacatgcggcgtcgacaccttctccgatcaccaccactttgtctttctcttctccttctattcccacaaacgtcactcctgctccgttatttaaacatgagaatatgagatcattccatcaagcgaattagaacgaatataatttgctatccatagcatcagtgccggctctaggggggtgccagaggagcaaaagcacagggtcattaaatttttttccaattttacttgaggttttagggtccaaaattttcagtaattaaaaaacagtattaactaaagccaatttctataaatcagcacaaggtctttaagaagtttgagccggccctgcatagcatagtcaaatgccggttcgatatatatatttggattctaattgatatcttaccagtggttttggctccgatcttgagggcttctgaacgacatttgtcgcacctcatacttaccgacatcaagattttctgctcatgaaaattccaatattacaaataataatactgctacgtatatacttcatcctaaaaccttccgtatatatgttagacttttagaatacaaatgtttttagcgtaccttggccattttggaacctcttggagaaaatgaaaccttattttttttgtccttttggtataaatgattactataatttacgtgtgtaaatatagaagtgcttctgtctttgtctcattttcttatggcacattgcttaacatgtattaatatgcatattttatttgtactattatttgctacgaaatcgcagagtaattttcatgcaactgcttcgtagttaatattagtataaatgttgacgtttaagtggacaatataaggtattgcttgactcataagggttagatttggttaggtaaaggttagatttttatcatgcacatctaaaaagtcagtaccgtgaggaccacgaccggtcctgaattataaaaggcccgaaaggaaactagtcccttatttcgtgtttctgaataaaacaaattattaaccttaaaaccaaataaaatttagcaaactgaaaattgtaaacaaagaaacggcactacatcctacttgcaaagaggtgtcgaacggaccggcccacaatggccattagttttagatggactgcaacggagcagtccgctaggaccgcagacaaaataactttctccaggttcgccctgctaaacccaacaagtttatggaccgatccgtaggcttagtttttatatttaaaaaataataaatatatatattttaaatattaattttagttatttttaatttaatttaatttttaataaatactttttgtaaatattacaatttaaaaaatttaatttcttcatattgttacatattttacatattataataggattcataattaagtaaaattaattattcttacaaattatttatttatttttattgaatatttgtagtctgcaggtcaatccgccaaaccgtgggtcaagtccactaaaatccgtaatccgttttggccgatccgcaagacccgttatttttcggatatataatatagtgtccaaacccgctccatcatggtactagcccgtgagtctttggcccgcttgacactgatacatacatagtttaaaaaaaaaaaagtatattcgggtaggtccaaaaacgggttgatcagttcgcgggtaaaaccggttcaaccaccggttaatggtttaaccgtcgttttaagttggttttgtttttcctcctgaaacgacgtcgtgtctctctctctccctctatcttttgcgactctcctcgtcttctctgttcgtctgccatatgagtccttcccaagcccaacttttctgaaattgaagtgagtttcttcccgaatcccttaaagtttcaaacttttcaattaacttattcctctttctcttgtttctatccgaatcgtgtgagggttttcattttctatgctctgatttggtctcaatcgatgtacgtttataatgaatgtgtgttctaaattgtaataaaaaatgactagtaggtactagttgacagctctccacagttgaaaatctctcttttgtatgaggtaccaattgacagtctttgagtctttccttgttgttttgttatcaagggttctgagctttgtgtctttaggttaattttctatgttgtgttatggaaaattggtcagtgaatagccaaaccaaagattgtgaaatctgcattttgattttggtgaaaaaaactgtatagaaatgtcttaccctcaagaaacttttatattgcataaatgaatagcttagttgttatagggtttggttgtttcaataacaaagaatagaatttggtttcttatactttataaacttccttctttcagtcttttgggacagagatggcattaattcagaaaccagtggtgtgcaaagacactaataagatcttcatgaagcaaatacttgcgtttactgaacaggtataatatagaagtgttcatgtatatctttctaatagtgtgctttataacttgtaaatcaggtcttttctgaatctctcgctttccatatgaaacctctttgtgaattacatttctagtttgagacaatgtcatgtttgaggtggttaagacgataagaacgttgacattttctgattgaaaataaaagacctggcttccattaactctgcattggatgcttactctaattattttctgattaaagaaagacattcccttaatttataggtgaccattacacagaacagtaagctctcgccacgcacatggcacaaggaagtgatataaacggactaacttgtagtctctttcccctgtcaagaattagcaaatcatccttcttttacttggtatcattgacttttttttttggtggttggggaacttaaatatgtgttttttggtatctctctctctgccccctcttcttggtatcattgacttttttttttggtggttggggaacttaaatatgtgttttcaaacgatttttgtgtgatgattttaggattgtgatggacagttctgaagcacatctagatagaattgaggcacagaggtcaacggatgtgtctcatgaccaacagaaaaaaagatacttcccaatgaatctgataaacaaagtcgcaagcaaactctgttcacgaggaggagatggcgccacgccacctatgggagacaatgaatctgggctagagttcctcaacaacctcaaattatcggatcttttccatctcccgggtgaaaatgtccagatgaatacggaagtttttagcggactgagtgatggggacaaagagtgtctggagatgttgaaaggcgttggaacgccaatggcatgtctcaagagcgatagaggagattcagttcttcatcttgctgctagatggggtcatctagaactagtgaagaacattatctctgaatgcccatgccttgtattggagttaaacttcaaggatcagcttccgcttcatgtggcagctcatgccggtcattcggctattgttgaggctcttgttgcgtcggtaacatttttttcagatagactggctgaagaagatagagagagactaaatccatatgttctcagagacaaatatggaaatactgctctgcacttggccattgaaggacgctatatggagatggctgcctctctggtgaacgagaaccagaatgcttcttttcttgaaaataatgagggaatatcttccttgtacatggcagtagaagctggagatgtgactcttgtgaaagaaattttgaaaaccgcaggtaacaatgaccttgaagggaggaactctaacttagattcaaagttggaagggagaaaacatcttgtacatgttgctttgaatgccagaagtataggtttatctctcgctttggcatttagtctgttcaaatttcttatgtaaaaccagctgcgttatgctaattgttgttcccaattgtttgagcaggtgtccttgatgttattcttaacgaatatccaagtcttgaggacgagcgagatgaagaaggaaggacttgtctatcctttgcagcatccatagggttttataaaggagtatgcaacctgttagaccgatcaacaaagaatgtttatgtctgtgacgaagatggttcttttccaatacatacggctgcagagaacggccatatcagaattgtcaaagagattctaaaacgttgtccacattcaaaacacatgctcaacaaacttggccagaacgttctccacattgcagcaaagattggggaacataatcttgtaaaatcgttgatgcgaagtgatgatacaaaacatttgggtgttggtcaagatgtggatggtaatacacctttgcaccttgctgtcctaaattggcgctaccgatcaattagaacgctagcttcggatgtaaagatactgcaactacgaaacgataacggcttaacagctaggggtattgccgagtcagtgctgaaacccaactacatctttcatgaggtatgcctgattccctatatcataccatttgatcacacattaatgattttatagcttggccatttttggattacagaggttgacactggcattcttattagacgctcacgcgtttaggggttgtggatctgttaagtcgttaacaaaaccatcagaaccactagaccatgaaaagagcagagattacgtcaacactcttctactggtagcagcacttgtagccacaatgacgtttgctgcaggttttacaataccaggtggctttaatagctctgctccacacttaggaagagcaactttgaccactgacccaaatctcttcttttttctgctatttgacatattggcaatgcaaacatcagttgcatcaatatgtactcttatatatatgggcgcagttgggtgatccatcactcgtttcatcatccttaaatgtggccttgcccttactgcttttttctctactctgcatgccattggcattcctttgtggtgtggttactgcggttgggcatgtgaaatggtttgtagtcatcatttccttaatatcggcgttcttcttctattgggcgaccagtatccttgccccccacgtcatgctacagctatcaaacgtttctcccgcgtcatgtgtttatctcgatctttgtatgtgttatcaagagttggtgtcaggatctcgatcgggccgtttaattcctagactccgtcatttgatgaggccgaagaaagattaagctccttaacttatgaatggccaaaagagtcaaatagtcaatgatcaactttaatttgtgtcaaaaaaaaaaagaatggcaaattaatagagggaaaataaactatttttgtttcacacaaagattctgttctataatttcatttggagaaattaaatttaaataatatctacaaaaaaattgtccatctattctttttttttggggttttctgcaaaataactctctaagtcaattttgtttgcaagtttaccattcaagtctgaattatgcaagtcaatcctaccatttttaaagtcacccgcaatacaaccctcccgtgtatcgatgacgtgacatcgataactccgtttgaaaacaaaaggattttgtgcaaaaaaaacctcaattttttttttttgcaagataaaccttcatgtcaaataaatacaggtcaaaccataatatgaaaaatctcctgcaacatagcccttccgtgtatcgaaacgtgacagtcaaaggaaacaaaaaaaagacccacctctttcgccggcaattcagtcctatttcacatcagcgattcagtccattcctcccgccggcgattaactcgagtcctctcacccttggtttagcctctggcgatttaactcgagttatctcactctaatcatcaattgctctcgaacccttctcgccggcgattaactcgagtcctctcacccttggtttagcctctggcgatttaactcgagtcatctcactctaatcatcaattgctctcgaacccttctgccggcgattaactcgagtcctctcacccttggtttagcctctggcgatttaactcgagtcctctcactctaatcatcaattgctctcgaacccttctcgccggcgattcactagtttccttccgccggcaatttcagtcgactcctcccaccggtgattgcatggttccttgtttgtctccctctattttttttttcttttcggttccatgcatctaccttttcaattttcaattcatgagagatacaattttcaattgaagtttggtttgattttgcttaaatgtgggaaattgataattgaattgtatgtatattgcaagagaagtttagaaattttgttttcgggtttgtgttcttgtttatgatttgtggtgtttgagttttgttttgtttttaggttgatttactattacaatttagatatgtactagattaaattgctaagtagattcaatctgtagggtttatgttattcgatttgctttgttctttaattgctttgtgatgattcttttgtagatgtggaataattattggattcattagtgacgatatgtatttgaaaatattagagagcattacttgagcaactacataatttcttgagcagctacatagtttctcttgttagggttttggttagtcataatgttagggagcatttgggtgttttagttttgttttaagtttagctagattctttgttggaatatagacaatttgaaggttaaagtgttcgggttcataacgtaattattggattcatcgtcctttgtgctgttttttgcagttgtagttatgactttttcggttgtttgttgtgtagtatttgcatattcggtctttgataactttcagacaaatgtgttcgatctctgttttttttttatcccctaaactttgattttgatgcatcaaagaaatggtttctattgagtttgtgtacaatgggtatgtttagttttgtcgttgtccattctgtttctatggagaagactaatccaattctcatatttggcttcttgttttgtctttcctcttcttgattggatcaaatcccaagccttacgaatccatgaacccatcttctgttgactctggtttttagatttagcttaggtttatgagaatccataaaaaaaggtggcggtggtaggttttgttcttatcgaggagttgaacttgatttggataaaaagtcttcctttttcttattgattagttactagtttcccttttcatcgagaacagattcatatcttcacgtactttgatggttttgatgaggtgtttaatttgacttctggagaaactaaagtagcggttcttgtcggatctacatgttaacttttacactttatggtctcaaaacaccaaacatttggttaatgaagctatatcgtgttcatcctctaacttgctaagtgtgttgtctattacattcaatattttgctgaagctaaagtgtgtactttgttttttcaggcttttgatctatattacgtctgtggtttatcttcttaatggaaaccgatgaaggcatcacgagtatgagttcaagtactttaagatacaatttatttttgtttctcatgagagctatttactaataactctgcagctattatctcttgttttattaatatataagtgattgttatgtgcacacattgataaggagtatccgaagcgcttattcagacatggtagagagccttttgttggaaaaatcaacaacttctacaaaacagcatccttcagagaatcaagaaagctttgccattagagtataaagaagtgaagagtgatcctcagtttgcacacgtctttgccatatttgaaagccgtttaggatactctgctcgtacggtgcatagcttaatgtgtagacagttggtaactaggaagaaacatgaactctggtttgtgtttggaaacaagcctcttcgattttctatgcaagaattctatgcagtgactggtttgaaatacgaagatgattttaggcatgatttagattcttagagagatgacaaggggttttggagcaagttgcttaagaaagggaacactatatgcattaagaccttcatggataagcaattatcagaagttcacatgtgggatgaagtagaccgggtaaggtttgtttatctgtgtgtgattgctgaatagtggttgctagggatgagaagaaaaatatcaaagtaaaatacatcaagttggtgatggaccttgagaagttgagagcatatcattggggtttacattcgtttgaaagttgtagtcaattccaaaaacagcaatctcccacgattttttcatcaaaaataaatctccactccttgttatcctacaatctccacatactactcctcacatagatatgcataatgaaaaacagaatacgagatggaaaaggaagaacgtgaagaagaagagatcaataatatggcacaaatcgactagggcacaaatcgtttgtttacaatttatttttgggcgttttttttttgtattctaaaaaaattagaatttgttttctaaatccagtaaaaatcgtaatcttaacagaaaatatactattaaaacgtaatatttaataaatatttactttcctttttcaaagattcactttctatatctaggaattctaaatagtttagaaacaaaattctaaatttggttagaatataaattctaaaagtgaaaatttcttagaaaacgttttctactgttttcagaaactataaaaattcttagaatacaatttcacacatagtttagaacatgaaggaaattttagaatacatgttctacaatttttagatattgaatatcctattttctaagttagaaagaaaaattgtctaaatatcgtagaatatgtacaaaatattagaatagaaattataaactaagtagatcactagaaatcgttttttaagaaatttagacaaaactttatctatcaaaaaaataactttttcaactaaataacaatttttttttttcaaatcaactatatttttttttctagaagatgttatcaagattaaactttttcaaaaatgcttaaaatatagagtagaggtattttgatccaaattggcattctccaaaaaaaaaagatatatatggacaaattttttatagaagtcctttagatttctattttctatgtgatgtaaaactaatttcctaattacttttaactcaaagctatttttatcaaatttaagtcactaatcactttagatccacaatattctagacttctagtaaaagaccacagggacgatgcttccaggagttgatattttctctgcagtaacttttggtgtgtgtttttaggggttttcgtaactctttctcaggaattttgataccataacacaatgctttgtccaaagaaagacagagaagggcttttttttgtttgtttgttaaagtgtgaggcatggcttggtgggtcaagtttagatcattcagaggagataaccatgaagagttctacacttcgtccattaacaaaatcatcagattattccttcctaattactagtcataccctaaatattcacttacattaatttctggtattctcttttggtagtggtcgctagatttttttgggtcaaaattaaacttcatctactttatttcagtaagatcatgtttcattgtgagaatgccagttcaataaccattaacacaatctcttgaccattttttttttggtttaattgatacttaaacaaaactcgaattggttcaaagctcaaattggtacatgattataagccaaactcaaaactgaaatacttgcctaaaacacacagattagcaaaaatcatcatcggtaatctccccaataaccaaatcaaaactagttttttcaacaaaaaagaaaattgtaatcgctatggctccgtagatcgtaaaacaagatccacaggttcctatcagtaagcgaaacacgtacatttgtttatgtctaatatagcgtcgagttaggatcattgccccaaaaaaaagagctaccttcgacgtggcatcagacaatttctacaatttagaagaaaacaaaaagaaaaaaccctcagcggacccttgtcaaatcaaccacacagcagacacagaacgaattcagtcacgctagctgttgtgtaaagtgtcatacggcacttcctatcttttgggattgcttcttcatcgggtttataacaatcaaaactcgtaaccaaacattaaacgatttcaagtaaacagagaaccaaaagaagaaaaaactaagatagaagaaaacgttgttgaagatatgagaaagagggagaagagaatctgtatttatatagagggtatttgtggcggcataacttaaagccctagcgtgtacgaggcggcatataacttgaaaccctaacgtgtacgaggcggcataacttcaaacccaagcgtttgatcgagttaccatatagcccattaagagcctatatgtattttgggctgaataaaatattattgggccagtagattgtggtagtagaaagagaagagctctaactacaaagactactagtctttgttccttctacgatgattgggacagaaaccaaaccattggttcaacaaatgtggtcccacgtgtggatctcatggctctagggaaaccacttggatgacgctgcaaggagttgatctttatgctgcggttccgttttgtgttgtgcatataatcttagagaaaggtactgtcttctcatgtactcttgttttataggtttttcctctcttttttaagaaaagtgtgtataattgtgttacaaatgttgcagatggagaggaaattgagtttgaatcaaacaaatcagagtttagtgaaggagaaggctctgttcatatcagaacttggggatcttgctgatagactcagcatcttgcagtctcctctacatctcattgtattgtcccctgtttttgcttgcacatgtttttgaaagtgcttaaaacattgtttcaaattcgcactgcactttactggcacacttataaggtgatattgtttatcacacactgtcaagaagttaaaaccattagatgttgacaggactgaacattagatagagactctgtacttctcacactcatcaaactaagcacatcatataaagagacaacgatgacaaaagtgaatcgaaagagataattgcaatagagaataagttcgatttgttgtttgaaagaaaagagagatgaaagaaacggaaacatagtcgatcaattatttatcagaggctgtacatggccccaaaacataaaccaccaaagtactagatgaaacgatacatgaacttggttcagtaaccataagagagagagacaaggtttagaaaccaccacggagacggaggaccaagtgaagagtagactccttctggatgttgtagtcggccaaagtacgtccatcctcaagctgctttccagcgaagatgagacgctgctggtccggaggaatgccttccttgtcctggatcttagccttcacgttatcaatggtgtcggagctctcaacttcaagagtgatggtctttccggtcaaagtctttacgaagatctgcatacctccacgcagacgcaagaccaaatgaagcgtagactccttctggatgttgtaatccgccaaagttctgccgtcctcaagttgctttccggcgaagatcaacctctgctggtccggaggaataccctccttatcttggatcttggccttgacgttgtcaatggtgtcagagctctccacctcaagagtaatcgtctttcccgttagggttttaacgaaaatctgcataccaccacggagcctgagaaccaagtggagggtggattccttctggatattgtaatccgccaacgtgcggccatcctccaactgctttccggcgaagataagcctctgctgatccggaggaataccttccttatcctggatcttggccttaacgttgtcgatggtgtcagagctttccacctcgagggtgatagtctttccggtgagagtcttaacgaagatctgcatctgttaatcagaaaaaccgagattaatcgacaaattcgatcgcacaaacaagaaactaacaccaaatctagataaaaatcacagatcaaagcgtaaataatcgagaacacacaaattctttcaacaaatcggatcaaatacaaggaaacaacaagaaaataaacagatctgcgaaaaatacgaaccctaatcgagaaataagaagagatctaacgatgaaactatgtaatttgcctccgatcagagattaacgagatcaaaatcaaagaacagagcctaaattgcgatcgaacgaaacaaatcgaagaaatacaataagaactcagaaatctaccttgatcacggttgagagatttgagagattgattttagagtttgagaaaattggaatctgaattgtgaagaagaagagctctttgggtatttgatttatagaagcaaaaaagacgaggacgactcggtcggtcacgagaaagctaaggcgtggaagcaatagccaattataaattgacacgtatgtgtagggacgtgtacgcgttgttcacacgcaaagttgtttttggctaattgccttatttttaggttgaggaaaagtattttgtgcattgagttgttaaaaatttgatgtaaagatagtttgctgcgagacatatactgaaagttgaattaccattagatgagatcattagataatctggataagtatgccaagaagttctctgagttgaaatttgaattaagcacaactgagagacatatactgaaagagatgggttttgtttgtcatgttgaacactagaaacacctccggaattgaggcaagaagcttggaatttggctaatgatagtctgcgtacaaccctttgtgtaaggttcacaagtgaggttgtggcttgtggggtcgtgtatgctgctgcacgtaggtttcaagtacctctcccagagaatccaccctggtggaaagcatttgatgcagataaatctagtattgaccaagtgtgtagagttctagctcatctatacactcttccaaaggcttagtatatctcctctgtttgcaaggattcaggtggacattcagataaatcaagacatcactcttttgcaaatatccttttcatttaccaaacacgatgatctcctctgcaaataattttgggattactaagataattgatcataaatacaatcttctatctcgtcacacaacacattttgactcggcacaaaattaaaaaaaaaaaacacatacacacactttttggtcttggtggtctttaagtttcaagcagcgtctactcctccttgttgttgtgcaagatatctctctcggcgttgcttctggtcattagtacagaagataaacacagttaacatcagtatcacactttctttgttgtcttataaaacaaaacataaaaagaagacgagagtaaggcatgaaaagaatggcattcgtctctcacccattcatcgatcacaagcccttctccaattggctttggaccaacaataccctctgatgcttttttccgtgcttcatctgcagcatccgcttcagccaattgactcttcaatttctccatcatctgtaaagagagaggtaacaaagtttaaagaatcagtgatatctaggattgcttaaagcagtaaatgatcccaatcaagttcacaaatgatggcgataagaaccagaaaaagaagaagaagcggacggactcacggagttagggttttcgggatccaagaataccacacgcattacttgctcctcagagacatgatctttttgctcctcaaactgcaaaacacaagagcatccacacttcttagaatccaagaacaaaagtcttattttatcttatcttctctgtttctttctgaccagtagttactacaagtttcacataccagctcaggcatatagtctgttggaactttcatcttcaagctcatgattttaaacttaaccccgctcttttgttccattggcttttcattattctcaggaggctcaacaaacttgaaaactaaagaattcaacaagacatagaaacaaacagtcaccacataatcatcgaggccaatgataaaaagtaccctaatcaaacagtataaagaaacatatatacaagagaagcaaataccagttgcgataatttcttccccgggagcaagaatagcaccagccgggcgcatgaagcaactctttggtactgttgtttgaaactgagtaaaccaagataatcagcagagataaacaccaatgacaacaacaacaaccataatcaaaacgtttttgaatccattacaaaccttaaacgctacatgtgacttgctcgtattcttaatcttaatggcactcctgacttgcttcccaggctcatctacatacaaagttcataaactaaatcactaatctttgatcatcaataaagagtgaatcttgaaattgacaagactccacattttattcctaaatttgctcaatggctttatacagtttatagtaacgtatcaataagtcaaattacaagtcaacatcatcatcaccttcaatatatatccaatttcatgattcccaaagataaagctaaaccagttaagtcaatatcaacactatgatccaaaaaaaaattcgaaattttatagaattgatcagtcaaagtcttcgatgagatccgattaagagtagaagaaactcacaagggaagtaaagttttgctgaaggatcaagctttaatcggcgttttgttggaagaagcgatctcgcgacagatgacatagaagggatcgtggcggcggattgatgatggttttgacccaatccttcgacgacaggaggaccgtgatattgaaaatggcgagattgatgaatgtaattttgatttagatgagaagatgttacagaagaagaagaagtagccatggaagaggacgaggaggctgaaggagcttgggaattagagtttcgaaatggaagtttgaatttgccccaacgtcgaccatcggaatctgatttgtcctccgttaaagccatcggagaatcggacgcgagagagggaaggattaaagtggatttgattgggttagtgtttttttattaagcgagaaagtcatctgaagtggagaagaagatgaagagctaaaacgcagatagtaatagcgtttaatacgatagcgtttggattcgcttaaagcttactttttggttgttgtagtgattgcgttctgaaaagcaataaaaacggttgagttacactcaaaaaataaggcttgggtttttgggtattcggattggggtcggatcaggttcgagtcgagttttttgggttcgggtattccaaatttagaaatctaagatccattcggatattgtaagggggtgttattcgttaatggattttaatagaattgaaatccacactaatccactgttatttaactaatgattctaaatccagctttaaaatctagtgttattggaactcatatttgtaaatcatgcttaatagattctaaagtttggtgttattcaattaagatttgaaatatttcattaaaatccaatgttattcaaaactaaaagacttttaaaatctttgtatattaattgatttgaaatgaaagctctttggagtttcatgagtaaatcattaaaatcaaaatccaagacatattgcagagattttgaaattcatacaaacatattcttaaaagcaatatcagaaaacaaatctaaagcttaaataattgactttaacaccataattgaataacaccacctaagactctaagttagattcggatctgtttttcggattcacccgagtatccaaaatcaaaattttgtatcaaaatatttaaattacttaaaaatatataaaattttctaacaaaatttgagtattttctatccaaatctattgaaaagtaggttaagtatccaaaatatacaaaatattttaaaattcaaatattttaggaacttaagttgtgtaaatattattaaattatttttatgtatatattttggatatgttcggatacttgatcgggttcatattcggatcggtttcgaattcggatttttgagttttgaaatttgtgatccgttcggatattttaaagttttgaattcaagtttggatcaaaaatttttatcgaatttgattcggttcttcagatttagatattttgcccagacctatcaaaaacgattaaaaatgcgtcaaaaatccgctgtaaatcttcgcttagcttgataaataattgtaccattttaacgttatagcttgacaactccaaactatatgaccatctcacatcttacaaaatatcttgttatccattattataatcgtaaatgtagacttcaaacaattctagtatcaaccaaaatggaccaaatctacctatttcagcatttttatttaggcatggtatgacaatttgctgagtttagaatacaacttttatatatcgatttatttaacgatttaccaattatacattatctaaaaatcgacttattaaaatccaaaataacatacttattacattttgagtcatcgtctttatcaaactaatttttttgtataatctatagttcaaatccacatgtaaatacatgatttggtgaagacaaaccattatcttcattgatttacttttcattttatacatgatttacataaaacacaaagtacaaagaaaacgaaaaaaaaaaaaaactattcacagagaaaacaaaaatccaaaactcaaaaacacaaacagaaacgttttggtttcgttttctcatctattattttctcaaccagatctaacaagatccccaacagctcagaaacatcaccgtcctcaaagattcctccgcttgcctcagcctctcactcgccgccgcaccaaatcgactcgattccagatctcctttaagcctcctcaccgacgacgacgacgacgcactctgtggagacgagaccgattctttgacggcagatcttaaagtcgtatctccgccgcttacaccggtaacactcttctccttcatcaacttaccggaaaactgactaatcactctattcatccgattataaaatttccgatccttaagatttttttctgctgatttatggcttttcagattccgaagagagttttttcttttgtgaagagtaagagatgttttgtttatatagacggagaagtgagtgagccatatgatttgggaggagctaccggtttagacggtaataaaccggaggcttgacgaataattggattactgttggataagtgactgacacgtggcggttttaggaactttcgcgacatgttggtgtgggaactgtggatatgatcgaagaggaatggatattttattactttaattcatttttgtttatttggaaaagttatttataatatctgtgtcgttttccgttggataattatgaatcataagatgttttttactttgacgaagaaattaggttgtgatgtttcatttaatcgttttctagataacgttttctgtttttgcttcactttgtcgtctaatttataaattctttttttgataaggttgtctactcgaatttgaccaagatttttttactatttataaaaatatgtcaatcgtgctttttcttcaacgtgcattttatactaatttttcaattctaaatcatctcgaaagtgttagggtttattagattgtgtatagtttctatactaagtatatttgtacataatagaagtcattaagggttcggtatagtcccggtttattcattctaattaaagtgaatctctggtttatttttggtttagttggtttgttgtctatacattgatgtaacaaactttctgattcattaatgagaaattgagtttttgccatgttctctctcggattcatggttcctattagggttcaatgttataaactacaatcgttttcatgtcattttcttgtattgtaaacaacgtggtggtagtctagtagtaaatttcccatatggaggtgttgggttcaaggtatgttgggaaggatctatttttcaaaggagatgtatttaatctagacttattagaagtgttgggttcgaagcatgctggaaaagatctcttgtctaaaaaagatgaatttaacctggtataggtctctgtctttggaagatataaggcctttgaacttaaattttcagatattaaaaaaaaaaaaaaaccagaatacgtagaaatgggatattaaatgaaaagaccaataaaaaaaagaatttggggtccaagcttgtctgccactgagttgttttccttttatgtatatttgttgttgtatgcatattgttgatcaattttataggttgtttagaatttatcaccatgattatctatcggattctctacaccataagtgttctacgtacagagccaaaagcttataataagcagataataacctctttcatctcatacaataaaacccgagcttatatgtagaccaccacgatggaaaatgccatcgtataattagatttgtatcatccatttgatggtgtttggtcgtgactcgtgatggtgatggtagtttaggtaaagtatgcaagttgtcacatattcgagtagcttgcaactattgtatttactcttgtggatttaatccaaaaggttcccatattttacggtttataattagatcattctttatttgcaaactctccattgctagctagaaatgtagtcatgtatcaccatcctaaataaatatgtttttggccgagatttgcagagtctctccatgtaataccgacttcgcaacactcttgagaggaaatgattcggattatggaggaattgtgtaggtccctaaatccccaaccctttccgtttctggatccgaccgatgtttccatctaagccacataatttcagttttgcttttagtttgaacccacaagattaaaaacgaggacaagattccatatataacaagtggtcgtagcaatttgaattatggcataatatagaccgacatagtcaaagaagcgaaacaacataaccatagccacaaacaaataatattttctttatttattatatatggctttttcgtcaaaagaatcaaaaccacgaaattaataagctatagaacttatatataagccaacaaaaattatatcaccttcttaaaaacaatttacgctaaaatatttgataaaatagatcacttaaatggactagttttgctttgatgaaaatttgctgtgttggccaaagccaaagaacaaatcttctaaatatttagaaaattagtttagattttggttaggtgcacaaaaaagaaaatgtttagattttggtttaggataatctcaattgaaaaaataacttccaaaatgtgtatatatatatgttaaaaaaattaacatttttttcttttcaaaatagaataacaaaaaaacgaatatgaacacattgagaggaaaaagtttttttaggcttatgttgacacattgaaaagtctcaatgaattcattttattagtaatagatttaattttaaacaaaaaatagcacaaatctagtgtgtaacccttagtaatagttaaaaaacagtaaatgtaatgcaatgcaataaaaagggttctaagtaatcatcaatataagctaagcaagcaaatgatctgttcttatattcaccaatgtcaatttcaccaacttccattacaattttcaaacattagattatatctaggacctataaacatcaaagggtgctaagtgtagcgtagcggttttttaaaaataaatgtaatatcaattcgattttttttttttcaaacagagtgcaacgttttagtaaatgtttttatgatattatgcaaatcaaaactactctgccgatttctttgtctccaagcaaaccaagcttccatacatctattatatcttctatctccatgttcccatatagaagagatgtgatttcgaacctgtttgtccagatttcgaagcaattgcgctggtggagttggttcttctccatgcttctatgtgagcatcgaaccctcaagaacactaacgaaatcgatcggacactcgtgtgagattgaacacaaagaacttttaaaagagacacatatgattttacgagttcaggctccgataaggaaccctacgtctcgccggagatgtctccggaattcactaaaagcacttagctcaaaacgagctttctctctctacaatcgttctgttttctctctctcacttctcttgattcaacaaacttctgaatcaattgaatctacaaagaaacaaaatacttaaaggaaacagaagaagacgagtaaaggataagaaaatgccgttgagagtaaacggattggatcgctccacatgtcacgatctccttagctcgtcaaccagttgaccctgaaaccttctgaaacacttagagagtctctgatacttagcgtatagatcaatacttcttcaaatctccaccttgatctttatgctctgctgcctttagcttttgaattcctctccggtacctgaactaacttgttcagcttctttttcctgagtaaacccactcagcttcttctccctgagtaaacccactcagcttcttctccctgagtaaacccactcagcttaaaacccggagcaaagctccaccttaactttgagatactctgagcaagtcaagagcgtcttgaaacttgctcactggtagcactttggtgaatatatctgctggattgtcttcagtgtcaatcttcaatatctgcaccacaccatcgttcaccaattctctgatgaagtgatatttaacatcaatatgtttggtcctttcgtggtagactgcgttcttagtcaaggcaatagcactctgtgagtcacaatggatgtttactgatccttgtgcaaaacctaactcacttacaagacctttcagccaaactgcttcatttgctgcatcagttagagccatatactcagcttcagtgcttgatagagctactactttctgtaagcttgacttccagcttatcgtgtttccaccaaaggtaaacaccactcctgaagtggatctccttgtttccttatctgcagcatagtccgagtcacaataaccttctaagactagctctccttcattcttatagcacagctttcggtctaaagtaccaccaatgtatcttaatatccactttactgcctgccagtgttccttcaatggtttactcatgaatctgcatactacaccaactgaatgagctaggtctggccttgtaccaatcattgagtacatcaagctcccaactgcactttgataagggattgttctcatgacttctgactgtttctgaatctcttcatcagttgcaggtttcagtttaaaatggatccccagggtgtgttgactgtcttggctcgatccatgccaaaatctccaagaactttcaggagatagccctcttgagaaatggagagagttccagcttgtctatctctgacgatctccatacctaagattttcttagcatcccccaagtctttcatttcgaattcagagtttagaagaacctttaactcacatacctcctttttatccttagatgctattagtatatcatcaacgtatagaagcaagtagatgtactctccactctgcaacatcttgaagtaaacacagctatcatacttgtttctttcatatccaatcttctgcataaactcattgaacctgttgttccattgtctaggagactgcttcagtccatacagcgacttcttcagtaagcaaactttgtctggatatctttcatgagtatatcactctggttgctccatatagatcgtctcatccaggtagccgtgtaaaaaggctgtctttacatccatctgttgtaactccatgtctaggtgagcaacgattgatagcaggaggcgaatagagacatgtttcaccactggtgaaaatatttcttgaaagtctattccctctttctgtgagtatcccttagctacaagcctagccttaaaccttggtttctccactcctgcaattccagctttccttttgaatatccacttacatccaataggcttctgtagactgtttctctctacaagaacccatgtcttattctttatcagagattctatctcctcatcagctgcttctaaccatttctcactatcagggtcttgaactgcttcctgatagcactcaggttcagaatttcccccatcctctgttatgaggtaagcatagcctgcaatctcatctaatacttcctcatccatctcataatccttgagtcttgatgggataatcacttgtcttttaggtcgatctcgagctatctgtcttgttctctgatttccttctggtgtagtgtctacctgatcaatgtcaatgatttctgtagtctcatcagaaatactctctgtagctccaccatgatctgaactgtctctggttttactggcacctgcacattcgaagatgggaactttattagtagtcaaagggagttcaagacttatacatgaggttgtggcgttcatgatgtccttgtacatcacatcttctctgaacacaacgtttcgacttatggtgcacttctcttcctcaatcatccagactctaaaacccttaactccacttggataacccacaaacactcctttcttggctctaggatccagttttccttcttgagaatgaacgtatacaatgcagccaaatcttcttagtcttgacagattggaaatcactgaggtccacagttcttcagggattttattctccattgtagatgatggtgatttgttaatcaagtatactgaggttgaaactgcttcagcccaaaatttcttgtctaagccactttcactcagcatacttctaaccttgttcatgattgttctatttaatctttctgcaactccgttttgctgtggagtgtaagtacatgttctatgtcttactctcccttccttcttgcagaaacaatcaaacttttgattacagaattctaacccgttgtctgttcttaatttcttgagttttctgtcactttgagtctccaccatctttttccattcagtgaatgaagcaaaggcttcatctttagacttgagaaagtacacccaaacctttcttgaccagtcatctgtaaatgatatgaagtactgatattttccaagactgtgcggtacgttaggagatccccatagatcagaatgaacatagtcaagtttctcattagttacatgttgtgctgatccgaaactagctctgtgagtcttccctattatgagtcttcacaaaactttatctctgatatcttgtcattaccaaagcaacctttcttactcaaaacttccatagcctgctgtcctatatgtcccattctgctatgccataactgagtctgatctgattcacctgagactgttgtaagagagtctgcatctgactttctcgcttccgcttgtaaaatgtataacgaggctcttctgactcctttcatgaacacttatgatccctgaattacctttaagacaccgttacctcctctaaactcatatccctctgactcaagagttcccatagagatcagatttctagatatctctgggatgtacctcactccatgaaggatgatctgtcttccatcctcatttgtgaacttaacctttccaattccttttacttcagagaatgaattattagccattctaacctttcctgctttgccttctacaaagtctacaagatagtctctcctaggtgtcatgtggaaagagcacccagtgtccattatccattcttcttgatctctcttatcctcacttaggttagcttctgatgctactagcccgaccaagtcttgagcatcgtcctttaccaatgttgtttcccctgcaccatttcccttattcttctcaagccacttgtaacattgtctcttgaagtgaccttccttttcacatatccaacagactttctttccttctgttgagttattccctttgttgttatcacttcctttggcctgaaactttccctttacatagagaccttcaccaaccggtcttgatcctcctaaaccatctcttagttctagttcctttgattttgcagcactcacaacgtcatcaagttttatgccttctcttccatatttcaaggtttccttaagcatatcatagccttctggtaaagcacttagaatcaagattgcttggacttcttctggaacttgaatctaaagattacttagatctgatatcatctttagaaactcatctatgttctcttcaagagtttttgaatcttgcattctatagttgtaaaccttgagttgaaggtaaacacggtttggtagagtctttaccaaatacaatttatcaagagttgcccatgcttctgcggctgtctttgaatgttctatgtttctcagaactttatctccgacatttatgaagatcatatccatcgctttctcatctcgatcaattcttgctttttcctcttcgagaatcttttttttctttgctggatcgtcttcttcttcatctgtcaatgaagatgacttagtttgttccaccagcgcatcttttaatcccatcttccatagtgagaagtcgcctgatccgtcgaactgagaaatcttcagtttcgtgttcgacatccttgaatcgatctgaaattcttgagctcagaacctgggctctgataccaatttgtgatcctcgaaccctcaagaacactaacgaaatcgatcggacactcgtgtgagattgaacacaaagaacctttaaaagagacacacaagattttacgagttcaggctccgatgaggaaccctacgtctcaccggagatgtctccggaattcactaaaagcacttagctcaaaacgagctttctctctctacaatcgttctgttttctctctctcacttctcttattcaacaaatttctaaatcaatcaaatctacagagaaacaacaatactgaaaggaaacagaataagacgagtaaaggataagaaaatgccgttgagagtaaacggattggatcgctccacgtgtcacgatctccttagctcgtcaaccagttgaccctgaaaccttctgaaacacttagagagtctcttatacttagcatatagatcaatacttcttcactctaactgtttcgttctctccaaattgaatagagctgaaagttgtaccatgttaagaataggcaatgcatccccaaagacatgtctatgaggactgtttgaatatcattccatcttgttgagaatttaattatgacccataaccttcttgcttagccctaaccaaatctcgttagcatatccacatgtaaagaataggtgttctcggtcttctacctgctcactacagaaaatacaagatatgtctactccaacttgtcatttgatcattctgttccccgtcgttaaccggtttcgtgtcgttaaccatgtcaaaaatgagtatttaaaatttaagagtggtcgtgtgataaccatatgccctaatcccattcggcggtatcggtatgtattaatgtttccgcagggacttgaagcagtttcactgacagttacagcggttttacctccttaatttttatgttttagactttgttcatgtggtagttgtgtcgtagaaagttaataatagaaatatagagcaggttttgatccaaaataaaaaactaaatacagaaagagaatactttcacatacggaatttccattagtgaggaaacatgtcctttttatttttttgtatatttaacatttcccgaagattagaaaccgcatattatttatcttagtgaaagttattaaaaagggcccgacacttgtttacgttaattactaccaaaaaaaataaaataataacttgtagaaacctatattaataatcgtagaaaagagtgggctagctaaagagttgaaaaccctaatttctacatactaagaaaataatgacgatgatgttcgatcttacgcaggatttggtgaaagagatattgtctagggttccgataacttccctaggagcagtgagatccacttgcaaaggatggaacgctttatccaaagatcggattctatgtaaagcaaaaccaaaacagcagtttcatcaagggttcatgctgtctgattataggcttcgttcaatgaggttcaatatctctggaaccttcaaggaaaatggtgaagaattcgttaacttatcagtaaaggagattggtaattttcttaataaagttgagatatctcatatgtattactgcggcggtatattgttatgtgtcaccacggatactaggctcgtgatttggaacccgtatttggggcaaatcaggtggatccaactcaaaacagaaactatgtattccacgttttgtctcagatatgacaacaacaaaaaccacaagatattgaggtttctcgataataaacagggctcatacgaaatttacgatttgaagtcttattcatggagggcttttgatgtcattcccaagtgggatatagatgatgatgggcagagtgcatcggtaaagggaaatacttactttaggacgatagatgaaaccccaaatttactaatctgttttgattttacggcagaaagatttggaaagcttcttgatccaccttttcagcatggttggatgagtctatcctgggttagagaagagaaactcgtagccttatatcagcacttggatacatctatgatagagatttggattactactaagatagagcccaatgcactatcgtggacctccttcttaaaatgttatattgagcaactcattgctcttgatttttggtttgatatagattacaacaatttcttcattgacgaggagaagaaactcgcggtggttattgataaagtcgaatctgaagactgcaaaagatctaattctcacatcaattcttacatcattggagatgatggctacttgaaaaaaatgaatagtcttggaaacactgcaagatcttataccgcaattatgttatctagctgttacgtttcaagtttagtgcaaattgatgatcccattgcaagacgcagaagaagagagaggaacagcaaacgaaaagagaagaagaggaagggaaccaccaacaacaaggtgtaaatcatcactaccactcaaaaggaaacaagaagactatcgcttctcattcgttttttcttagagtactatctacttgattattatttgacactttttgttgaaacaaacatttttagcaggtcagcaattttattagaatacttctttgctctttagcttcaatttcaccgcaaaagtcaacatattttgagactaatggtgttctctgatttcagcaaataaacaaattgatgattgaagatcaaacatatatatcatataaagtgatgtcgaagatgcatattacttttagacttccttcatttcattaatttaggcatgatttacaaaaagttcttctccagctgcataaatttcttctttatcccaataaaaataaatttctcaaaacaaaacaacatcttcttcttctcgattaagtaaatatccagtttatttaagtattttactaagggaaaaatgtcatttaattccccaattttcaaaaaatggtcattgtatacatcaacttcgtatgtggctgtttaaaacatgaactaaacgttgactaacttttaaaacatgatcattcgttgaccagaccaaaatagacatgccgttatcagtcattaacggaacttctaacgtctgttatcatctgttaactttattagtcaagtttcaaattgtagccattttaaacatcaacttcatatgtggccatttaaaacatgaactaaacgttgattaccatttaagacatgaaaaatccgttgacgaggccaaaatagacatgtctttatcagtagaacctagaaacccgttattacccgttaatgactgttaatctgttcaaaacgacgtcgtttgagaataatctaaagaacagaaagattttttccatatgaaatcttcatatcaaaaagttttaagcagaacccaagaacatagtttgatatagagataatcgtagtaccagtaatcggaagcaaataaaggtgttttcgtttatatatttgttttaaattttaaaaggaatcatggaagcaaattgaaaacccattataagattgttcgtcttgtttgggcggttgtagaaatagatttggagaactggagttttcatttagaaaacaatcctgattttcttttgattattctcaaaacaaagtcgttttaggaatactaatagagtcgttaacaagtgataacgaatgttataagttcttttaatgaatgatgacaacatgtttattttggcttggtcaacgaatttctcatgttttaaatggtagtcaacgcttaattcatgtttaaaatggccacatataaagtcgatgtttaaaatgaccataatttaaaacttgactaataaagtcgttaacagatgataacggacgttagaagttccgttaatgactgataacggcatgtctattttggcctggtcaacgaatgatcatgttgtaaaagttagtcaacgtttagtttatgttttagacggccgcatacgaagttgatgtataaaatggccattttttgaaagttgggagattaattgacatttttcccattttactaatcacacgtttccgtttcatacagtattcatttgtgtaaaagtttgtatgaacggttagttccttcttctatttaagaaaccaaaagaaaaacgaagactatctttgcctattggaaatgattttgtcattttaagcttagtgtggaacttagcagaaggtgagttgaacacaataatgtgatatattcaagggaaatttggaaaactaacctacaaaaaaactataattaagaaagtaacactaacaaaaaaatgagatgatattctttatattttatatattaatcacaactttaccctctttccttctctctctctccttctctctcccttctccgcttgtctccctacttcttttttttctctctccttctctccctctctccttctctctcttcttctctctctcctctccgcctttctccttacttctttttctctttctctccaaatgacctctttgcttttttttgtttttagttacagttcattaattacctttttgtgagatttatttaggttctaagctttgttttttcttttttgtcttttttgaaacataattttaacatcaaaatgcatttatggtctgaaactaatttatcacttaatttttttgttcttcatagttacaggctcaccacatatctacaataaattatggatcattcttaaatattgataaattagggatcattcttagatctagaagcgatgaagggtttacgatggtagaaattctaaagggaaatagccaataaatcgattttgattttgaaagatttttgacagataatattctattttgtaaatatactatttacgtataccttgtactatatacgttttaaaatgaattgtttgttttgattaaggatgttaagtgatttgattagtgttttatattaaaagctttgggttccctatatattatcttagggtttagtattcttccatcaaaaagtatttaattgattatttggattcatcagaacaaacgtttctatttgaacaaatatatactattctattttctgtgatgatatgtatagaacttggtactactattcactttttaaaaaatttgtttccgatttttaaaattcaaatcatgttagataaacaaaaaaaaatctgtttttttaatagtattattagttttaaccaaataataattttaaacttacatagcaaacaaaattgaatgggatgaatatattttggtcacttttttggttgctccacgcgctatcacctctttcttgataagttgaaggagtctgtggtctttttaacacatacatgtgttacttactatattatacagtttatggtgctatattctttatttcatcttccaaataggttatttttgcaattcaccctatattcaaactaaggaaaaaaaaaaacaattgacatgatgcttcaatgaacacattaaaagttcttgtactcgtagtaatattttaaagtgtaacaaacggtaatataagacaagttctagtacttgaagtacttactagttcgattacattcttaaattttatgtaagagaatgagaaacaagtaatacaaaaacattgaaaatttcttctcatctgttgtttatttttcaaattttcgttcttctcattttatctgttattactcacatggagtctgcagagctcaatggaaggagcaatcgagctatcattttccttttccaccaatatcaatggatgtcaactcttttcggaaaacataacttgatgataatgactctttaagtgcacttcttttggttcgaaccagagatcttgaagtgcacttcttttcaaaaatgacatatatattcactatagtttattgacgctggatatgttagtacacaaatctgcatttctatattttaaatttattgtaacattaattccaataatatactaaagttaaattaaaaataaccaaaacatttgacaaatatttataataattattattacaaaatctaaaataatttgatttcgcaatctcattggagataattgtttttgggatattaatccctctctctctctggttggatttggagaaacctatgtaaacttaagagtatcgctaaggtcaactccattgcacaaataatataagggtctttagatactaaatgaataaaataataaggtaaatatctttaaattggtgcacagaaataaattatgtctttggggagacattaaagatattttttagaaacatctttgcttaggtggcaatatgtcattggttcttcttttgttcttttattttaatcacaactaaagatatccacttaaatttgtgcaatgtagatgctctaaacctttcattgtttgtcaggtggattctgagattacttgtaacttttgtaacttaggatcttctcttagatttgactggtcctacagatcctataatttctagtctctcgttaggttctgtggttgtggaagctattaagtgtggagaatggtggctctctaatagcagaagtaggaacccgatcattcagattcttcgtcaatgcctccctaatccacatgcgattaatcctctagcgaagaggacatttatcagtagaacatcagagataatgtccctccagggagcagcgttgccttagctcctctgtttctttcttgtttacttgtttcaagtgttcaagggtaatagtgttgtaatagtttttattctctcgtgcaggtttttgccttctgtaatcgttctctatcttaggtacgttaatgaaatggtacttcttaaaaaaaaaaaaaatgattttgcaatctcagccaaaaatataatttctcaacttcttccgaaaatgttttacatgcaaacttttagtcaaaccatcatcttatttacatctatttagtatctactttaccactaaaaaaatgtttttacatcgaacatagtttagtgttgcctacaaaatgtctctttgactacattaaaccaaattatatgtttctgtagtttcacttttgcattgtttttctaaccactaaaattgttgactcaaataattttgaatgcaatttattagtatataaaaatattgtagatgtatttataaaaaaaaattaagataatgagtctctcaccaaccaataaagataactataaacactatgatatatattattgtcttgaataattcaaagatgaaaataaaattttaaataaataatctgagaatattaaaatttatattaatcaaaatttgaaaataaatcttactatattcttagaaactttaatgttttatataattaaaagatcttagtttccagattggatcgggacttagttgaccaaaaattgccaaaaaaaaaagaagaacatgttaagagacaatttctccagttcactagtaactgataaagtgataacggagttggttggaacgtgaaacgcttataaaaataaaccggtttaatttcaccggtttaccttccgccgtagatatcagccgcaatgtacattctcgacaccggagctcgattctccgccgtcagattctcaccggtattcaatcctcctccaacatctctccgtagacgatacttcatcgtaaggtctctctcttctaccacacgaattgattacttctccatctctgtaacacaatctctgatctctccaatcgttttccgatttttgtatctccagagctaatcttccattcccaaagcatcaagctaagtatcataaagagcttgaggtcgccattgatgctgttgatcgagcttgtcgtctctgtgttgatgtaagttaatatctcacctctgtggttcgtcaatttcagatttggtgtctattaaagtttggtttttgataactgtttaggtcaaaagatctcttttttcttctaaagagaagattgttgagaagaatgatcaaactccagttacaattgcagattttggagttcaagctttagtcagcttgggtaagtaaatttgagtccactactcgttgagttcaagcttatctttgtatatttgtgattgcagagctttcgaaattgtttccttcaataccattagtggctgaggaagactctcattttgtgcgtgctaataaccttgtaagctctgtggtaagtgaagtcaaatcaaaagcaagcattggagacaatcacttgtctgatgctgatgtacttgaagcaattgatagaggtggcaaagatgcttacacgttttgcaacaaaccagctacttattgggtatgttgcattttagcattgtatgatggtttctctgagttccatttgttacggtcttactgttataagctgtatgttgtcaatgctccaccctgttaatcttaatacataagacatttaccatccacagtagattgtccattttgaagtttgtaaatcgtggtatgtatactcgatttttgtgtctcctgcaacagaagaaatggcactaagatagaaaatgatactcatatcctttgtgtctagatgatatgatacatttcatcgaaaagttttcaatatactttcgatgctttctacaactcgtgcattgatttttctataggttttggatccaattgatggcaccaggggatttcttaaaggagatgaggctttatatgtggtatgttaaccatgcgatttacttatttcctttttgtgtcatgaaatgtttcttgtaagggtcactgaaactatatatcttttgggattgatatatcctcaaaaacctccttgcttagctctattggttcttagaattacttccaagccatgaacaagaaaaaagattttgacatgtatgaggtttcatggtttttatatctgatatttacttcttcgtcatatattcatatgtaaaaatctcaggtaggattggcccttgttgtagataatgaaattgtgctaggagtcatgggttgtccaaactggccaggagattcttcagatggatctactggaaccctaatgctctcgcatataggctgtggaacgtggaccaagaagttacaaaatgtctctggcaatgtagccggtgattggataaggtgtttcgttgatgcttgtgttttaatgaacaaagcaagattttgtatacaagaaagccaaacctgggaatcacttcctctctctggtttcttcgacgcaagtactgtttcagaggacttaaaacataaagagattcttcttttgcccacatgttgtggaaggtatctctactaaaggaacaattttatctctttagagaaactatcaccttataatactactctattatgcctgtatgcaaattatgatatttctactcagttcagtttcctaatctgtgtgtacagtttgtgcaagtatctgatggtagcttctggcagagcatcagtttttcttctccgagccaaaactcagagaacaataaaggtacgcgattgtttgatctggatctatctttttcttactttgtggtagcgaggattctcaagagattgtcttaaataacatgtagtcgtgggatcatgctgttgggatcatatgtgtacatgaagctggaggaaaggttggtgaaatcatattacatatatttccaaatcatttaatcaatacgaggtttatggtctttcctcatgatagttttatgaacttaggaatctacacagagcctgaaaaggaacaaaacttttttcattctgaggatcatgatctctttcttgctctctaatctcatcaggtaacagattgggaaggagatgaaataaatttggaggaagatcaatcagaaaggaggctcatttttccggcgggcggtgttgtagtaagcaacggaagtttacataatcagattcttgagatgatctcttctgcttcaccaactctttgatttatgacactactactctctatacacttgttaatgtttaccgttactatttatttatcataatccttttctaacaataagcttaaaaggaaaaggaaaacattaacctcatgatatcaacctccttgatttggtactgtgtttttctacgtcatgatatcaacctcaatccctaccgtagccacgacggaattatcatcgttaggaaagagaggcacttgcgacaatgaggaggatgaatcaaagatggctctaaggaggttgaaggaagatggcggagtagtctctctcattgccgtcgtacaagcccaattactaaaacggagttccacttacctaacatgtaaagcctaaagacgacagagctcattaagatactgctcaatattcattgtcctcgctttacccaaactgtctatcgcatacaggtcaaatttctcatctttatctagctttcttttttaactcaacaaaagtttttaatttaatttgtttgtgttttataattttgatacaaaattcacataacgatatagattccccacagaagccagtagctagagaggataggatgtggtcgaagccgctggtaataccccctaaactagctggattttggatcttaacatttgtcctaaccatttgatcgttagagatttcactaaattcacataacgatatagaaactagctggtttttggtatacaaatttttttattttttactcttaaaattattaaattttacaactaaatcttaaaatttatttccttcaaacttttaaaatgattttaaaaatttttgcaatcgagttttagttttgatatttttcaaaattttatactattttccaattttaatactaaatttactaaacaatgttaaaagtaacatgaccttgaatcgtatcatttgacacaatcatatgatcgttagagatttcaccagtttactttgatttctcaccgttatgtaaatttgaaattcaaatttttgttctaaattcaagttgctaattatatgtaaaatattattaaacatgtctggaaggtgaaccagactactttagatcatcgggttatggatcatgaactaggttccaacacggtttaattaaataaaaatttattaaggtatttttcatttataaaaattaatatagttttttatcgaatgtccccaaaagaacaaagattaatataggtttataaatgtaaatataaaaataatcatacattaacaaaatatgaagcctaacgattataataaagtgactaaattttttaaatctaactaaaaccgaaaaaatactagaaaatcattagtaactaaactaaactagtaaaacattaattgcacgttccaaactaccagtattaagtttctaccaaaaaaaaaaaaaaaaaaccaagattggttgtttctcaccattttatcactgatagaagttcttaaactaattaaatacactagaaccctatattttatcccaaccggtccatcggatcacgtgggggttaatggcaagttataatgggttgtccggttttaaattgccgaatattagcactaaacccaatccgcgaacagattattaacattgacgaaattgcctatgctccttatagcattccagctcctttaagctaagcgatgccttttgcatttggttagcaacgagaagttaatctctttatctttctttctatacttccaaatatttctattcaaagtggcatatattataaacaaagttgttttgtttgaagaaaatttatacattcagaagaaagaataacaaggtaaggatagtgttttttaggttgtccagtctctgagatttcaggtctaggggattcaccgtatctcgtccagaagcaggtgaattcggacgccggacttcccgtcaaccgttgtatccacgtctttgtcattattttaaattctttttcttttttttctttttttctttttttttttaattttaaatttccattagataaaaaagaacttacaagacacaaaattccaaactaggcacgcaggccaaaaaacatacacggcccaaaggcccaaaaaggcacgcaggtccgaaaactaaccctgaggcccaagaaggaataagagggcccaacagaacataagaaacgcaaaggaggaaaaatttaccttagttgaagtagcgaaaccaagtagaaaggagagagttgtcgggggcatcaaattcagaacgcctagagagaggatccagcttagctgtaaggatgaccttgatttccttgatgattgcagtagaagagcgggaagcgtgatcatgcaatctacggttacgctctttccaaaggaagtagatagaagcttgaaacactagcttgatgatgagagaaatgttaggatcacgagaaggagataagacccaagtgaggcagtccataaagagaagcggaggagttaagcttgctctaaacatgaagttaccccaaaccgcaaaactgacaccacatccaaagaacaagtgctctctaaattcagcatttccagagcaaaggacacaatccgaaggaatagagagaccccacctcctcatgcagtctctagtatgaagccgattctaagcagtaacccaagtaatgaatgcgtgctttggaatatggtccttaaaccaaaccgacttatgccacacaacaggacggccagaagggtgaagcgcttgccaagtcagagcagaggagaaagagtgagaaggaggtctttgatcgacttcataggtaatgatatcattgcaactaggcagggcgtgctttgatcaaggagatgatgggattacgacttctagaacccataaccctccacctatcaccagaaattgcgtctcttaccaccgccttttttggcagacctatcacctgaagacccaaaggactcgtgagatttaaaagagaacccaaaccagtctaattatcgtaccagaaactagccgtaatagccaaacccacttcacacaccaaaaaaagtctcgccagactacgaagcttactcaaccgcttccaaatccaactcccagagttgtacggattcaaatccaactaccagagctaaattctatttcgttattttaatatcattaacacacctctattatgaaacctccaagaatagaaaccactaagtttaataattcaaatattctatatagatatagctactttactatgtggcacatcaactccacaactattaattccgatatcgtatcgcactcgcatatgtattgtaattttctatacataaataaatgttatatacataattacgtatgtgtgtgtggactcttggtctttgtctttcaactatttagaattcaaatggctcgtttctgacgtatcaaaatctggaataatgcgacgataatctctacgtacgtgactcgatttattttaacatacatactaatcaatcatattttatattaagaaaaattaggcaagtatcgtgtatatatatatatatagtatgtggctacatactattattgcccacatacagtaaaacctctataaattaatactcgataaattaataacctctataaattaataaattcttccggtcccgagttgggaccactataaaaattgatacaaatcgataaattaataagataataattattttgaaaattttatgtaaatatatggtcccatcaatattataaattaataattgtataaatttatgaatatatatatatatatatatatttatatttatgaatatatattatgtaaaacttagtaaaatatgactttagtattgtttttcttcaatttatattaattctttgtaaaattcaattctaataattttactacgtataaaaaagattttttttttaaacctaataatggttttatacttgtaattgatttttagaaaaattattgattgtagagaggaactaccttttggattaaatttttgtaaaaaattacaaattttttaaaatctctccataaattaataattattaatttatcgataaattaatacctctctaaattaataaatttttgtactattattacctagaaagtgaaaattgacctacaaatatatcttcaatttgattcacatatacgaagtcacgtatgtttctataaatttagatccaaaatgtgtgaaaacccatctgtttttgcaaattcttgcaattgcaattgcacatgtttctattacgtttaaatcaatcgagctctaagtgatttatccatagtgatatacagatccaatatccatgaaacatatttaattcatgaaaaggctcaaacattatcaacaaataagatatggtcaactatgtagtaactagtaacacgtaggctgctgctctttgtggcaaattcatgcgcaagcaaagcctctagatgtttgacaagttactaccctaatatagcatcactagctatcttctaatttttttttttagttattttaatcctgtattcttttatttatttatttgataaagtgatgaaattttattctcctttttcttatcaactaatatacttattcattcacataatttcgcactttgcggagttttcatttgtcgttaaacccgacagattcttgaaccgcaaggaacgagacattaacctaatgtacttatatttaactatagtattataatagcataaatgtgacaatgattcgatcactactaatatattaatcaccaatctatatcgtcgtccttcctgattatttgaagattttgtctataaactagctgcttttgtttatgtatttttattacttggatgcttttgtttgttggaatattcgaatgaatttttgtttgcctgaaactatgcatatataataaggccatatgcgccaataatatagaatccaaatattcattaactataattagtttgttctagagttttagctactcatatattcaaattcttaggagatcaaaaaagtacttaattagttaataaaatccatttttattagttgtaattaaatgtaaagtgtcgaaacacgaaagggaagatgagttgcacaactcgtggttcctataagagtgataatctatctgacgtcacgccatgcaaaatgtatcaatcaattttcttctcacatttatatttacttcaaaatgattataaagccacccaatgaataataagatatatatatatatatatataactcaaaatcaaaaatttcaaatggaatttggaagcatcacaaattcacaatcatgtattcaaaatctcacgtagaaaaagctaataagtccaaaagattggtcttcatttttttcttgagaaagtttgatgggatagagagagagacagagaggaacagctaaatttgctgtgtatgtatttaatacttgaacatttatttatctattttcttatacatcaaactcacgaatttataggttggtaatgtcgtttttataacattaataaaaattgcaattgtagtttttattgaaatttacccaaaaaaaactattatacgaaaatatgttatttatttaaaatttgatattagatgaatccagaatcttttataaaacttggtgtgtgtgaacctgcgttaatttgttaaatacttttcacgtaaaaatcaaaattaattttaaaagttatgttaccaaacagtattctgatagttttacaaattttatccattgtatatgttttgtttttgcaaaaaagtccaaaggaaaaaacaaagcagaagggttgaattgtgaggaaagagagagtacgtggcatcataactttggcgacagctaatgtgaaaacagccaaaagctacggagagcgacactcctcgacgacgtccatgtctctttagattgtgattgcattgttaattatcatatttatcaattgattagttaagtcttaagtatcatcacacaagtttatacattaatctatacagtgtttaacactacaaaactccccaaaatcacgtgtttcatatcatacgtacatttgtctaccgtctttattaacaatattaaaacagaatttatcaattttctagttgaatagactatatactattatagagactcttataaattatgaaactcctaatcaattaaaaatagttaatttgaaacatatcactcgaaactagggtattagttggattgacgatatttttcttattaatatcaacgagaagaatcaagtgtcgttagctcaattggtaaaaaatttaggcaaagcttagagatgtctatttgagtgacgcttggaacaaaaattacatgctatggtttcaggcctagagaaatgcttcgatccagaatctcttgatattcaaaaaaaaaaaaaaaatcaacaagaagaatgtataaatggtttctatactatctaagttatgaaaaatatttttggttacccaaattacaagatttgtaccgaagtgtcacactagattcacatgcatgcatagttataattaacttaaaacataaatgacttacaaaaatacttacaaacaaaaaccaaattaagttatttagtggccagctttgttactagagttttagccattatcataattcacaataaggtgtaggaaaaaacattaatatatagtatgtatacatccaaaaaaaactttttggaaaaaacaaattttgggattataaaggacacgtagcccaatcgatgaacagaggacggcaccgaatcaatttgacttcaccttttttccccatatgataagagtctcatctctttcctatatatatttcgtacctctctttaaggaccctacgtctctctctttctctctactctctgtttcctcataattcaatcactatatttttttaaaaacatttgacttcatcgatcggttaacaattaatcaaaaagatgggacgatcaccatgttgtgagaagaagaatggtctcaagaaaggaccatggactcctgaggaggatcaaaagctcattgattatatcaatatacatggttatggaaattggagaactcttcccaagaatgctggttagtatacgtatcttcattattacattttaatcatactttttttattcgtgaattgtctttttaaagttttgcttgaatcttgactatagggttacaaagatgtggtaagagttgtcgtctccggtggaccaactatctccgaccagatattaagcgtggaagattctcttttgaagaagaagaaaccattattcaacttcacagcatcatgggaaacaagtgagtttgaacttttcaataattttatatttttgccattacgtagtttatacgaaaactactaatcttgtagattagtcttagagtcatagctttgaatgatgttactagtgatttatgttaaatctacaatgcatcagattctaactttgtttgctttcgtataggtggtctgcgattgcggctcgtttgcctggaagaacagacaacgagatcaaaaactattggaacactcacatcagaaaaagacttctaaagatgggaatcgacccggttacacacactccacgtcttgatcttctcgatatctcctccattctcagctcatctatctacaactcttcgcatcatcatcatcatcatcatcaacaacatatgaacatgtcgaggctcatgatgagtgatggtaatcatcaaccattggttaaccccgagatactcaaactcgcaacctctctcttttcaaaccaaaaccaccccaacaacacacacgagaacaacacggttaaccaaaccgaagtaaaccaataccaaaccggttacaacatgcctggtaatgaagaattacaatcttggttccctatcatggatcaattcacgaatttccaagacctcatgccaatgaagacgacggtccaaaattcattgtcatacgatgatgattgttcgaagtccaattttgtattagaaccttattactccgactttgcttcagtcttgaccacaccttcttcaagcccgactccgttaaactcaagttcctcaacttacatcaatagtagcacttgcagcaccgaggatgaaaaagagagttattacagtgataatatcactaattattcgtttgatgttaatggttttctccaattccaataaacaaaacgccattggaatagagttatgtaaacatgcaatcattgtatttgttatatagattttgttacatatccaaaatccaaaatactatagttttaaaatatttattactaaagtatattcgtcaaggggaaagcaacatcccaccagtaaacaatataaagctcagctcataacattgttttaatgatggagtttctattattggtatctatctactcttttgtttaatatttgtggtcggcttttcttctacataaatgcatggagatcgtatcaacgatcatattaaaatatgattcgaagatatatactataattgatatcatacatggtgctgaaatgttatcgaaatagaaaggtagataaataattgatagtgaataattatatcattgacttattatctcttgtttctctgaagaaataaactaatgataatttatgaaccaaaacaatactaataacaaatgttttgaaatggaagtgggccattaagtcaatcaaaaatttgcacaatttcactagaaccaatcaaaatgcacgaaaaactttctattttgaccaccagagaagtcttacgaatttactaaccggaatccggcgagactggccggagcgtgaactagaagtacacgtggtatggtagcgtacgtgtgcaattggggtcagatcacgggacacaatctaatgaccagacgccacttgtacgacacgaaagcaataagtggaaaacgtaaggaaaaagttgaaagaaaaagctcgttttaattgaaatcacggtttgtgttaattaatcacctttaacacgtgttgtacggagagccaactgagagtggggacgcgtggggacaaagcagcatgtgtaaacacgaacgtcggcattttttgggatgagctgtttgttttgaccccttgttcggtttttccagtggatcttttattacgtatagagtcaacattttttataagaataaattattgtggtaattaaataaaccttgtttttttcattaaataaaaacttgtttagtaagagaaatttcatattattttctttggttttaatgctaagagtcttaacgaaattaaacaattacatatcttgccaattttgaatgcttaatttgcaactagaataaattgtatatatctagttttacttttttttttctttacttttttttggtaaaatatatagttttatttttgaattgacggaaacgtaagtgggttagttgagttgtttcttttttatatatacgtaattagatataaacgtgcggtataccgtagatactcttatattttagttaaactaaaattttttattgtaaaagtgatttataaatatataatattattttatggattttaaatgtatagtaaactgctagttgtatatttttgttgatattatttatattgttcagtatttaagattatacacttgtatttaattgttaattttagagtttcacctataattaccatcttgtattaatattgatttaaacccgtcaattctaagattttcaagcttgtattaaaaattgaatcacatcatacacataaaaaaatctaatatgttattaattattatagtatataagattataaattttcaaaataatatgtatgaaattgaatataaatatttaaattataacccgttacttagtagaaagttttctaaaatctatttttgacctgttataatattttttcatgtattgaacagtttatattcgtttttaaaaatataaatcatggcacatgcgaaaagctaattattcttttataacaataatattattttttcgcaaaaatagaatcatataaagatgagagatgaactataataattaataaaaaattaatatgataatttagatatcaaatctaatttgttgattttaattagttattttttttggaaattaataatgtatttcgtttgtctaattaaattaaattaattaaaatttggatatcaaatcttatatgttgattttgattggttacttttttagaaattaaaaatgtattttgttttttaattaaatttaattaattaaattagtatttgactttttaatatttaaaaagatgaattattttactctttgaaattttatttttaattgcatacctatgtaattacttacaaaaaatatggttattttattatgtatttcccaataatagtataggattatgttagcatatatttacaatgttaccacatttgattttatttttaatatcttttgttagcaatttttactgaatgttgaaacttgtcaaatgtcactattcatcacgattttcagtttgagcgagatttttatcgatttttttggaaactttaaaacactgtcgtcatagtatacttttttctaaacatcaaatttccaggactataataagagactataataaaagcttataacaataaattattagcaagttttaacaagaaaaattaaaatctttcatatgttttaggcacccttaaaaataatttccttaattgttattggccaacttttaatattatacagtataacctctataaattaatactctataaattaataacttctataaattaataaatttttccggtcttaagttggaaccagtgtaaaaagtgacacaaacgataaattaatatgataataattgttttgaaagttttatgtaaatatatggtcccatcaatatcgtaaattaataattgtataaatgtatcaactacatatatattatatgtaaaacataaaacatttccttataatatatttttaatatttttttgcttaaattcatatttgttctttgtttgaatataattatcatagtttactgtatcaaaactgttggtgttgtttgtagacattattattatattttcaataatgaaagaaattttatagaaatttttaaaaagttaccaaaattttgaaaatctttttataaattaataaatattaatttatcgataaattaatacctttctaaattaataaaattttgtagtcccaatattattaatttatagagattttactgtatatataaactctaaagttttaaatctaaagtctaacttcgacaccataaatagttggcttaaactacaccacaacttgtttcgtggcaagtctattaccgaaaaaaagaactggccacattataggcacaagaacatttttctacataacacaaatccagttttaaccattagaaagaaaaagaaaaacatatgaaacacaaaataaagcaaaaatatgataagaaagtgattatcatatttttctaataatagacagattgtttcaaaaagaaaaatatacttaaaaagtagagaaactaaaaactgagaaataattgacaaaaagattgagaaataaaaagaataaatgtaaatttatttatttgatttttattttgatttaaattaaatgaggtttttatttgttacattaactgtttaaattttataattaaaaggtaatttttcgaaaattcacagattaacaagtaaatttaatttagacaatcacctcataccaacttcatttttgtttaggttgttttttgtcatttcagttggttgatcaaatattttcttaattggcaatattctctgtcaatcaaacctacaaagtctctaagacatgtaagtactttgggcggtggcatatgaatcagttggactaaaaaggcaaatcttgttttacatgatcccaaaagttgttttcattattccatacaaaaaacacgttttgtcctcgatatacacttgtgttgtgtatttgtatgaccaagattttcaatatcagagttttcttatacatcaccgtgccaaactctaattcaaacaccaagatttcgtcgtttatatacggctgtatttttccatttcatttattgtttgttacactataatatctacgtactaaagattttatagtaggaatggatcaagtttactatactaaatgactttgagtaatttatatagatagttatcttttgaatttcttgtgtaggagaaatgttaatgatcttaatcgaccaagagactaatcaatttaatgtcgccaaaaccgaaagtagactttatacaatgtttgataatttagtaatgtggaaataagcttctataatcacatgggttatataaatgtggtcctaacagtacgtcatttatacgtcatatgaggtataacaatatataataagttggatatattagcatagaggacatttttaaaaatgctatttagctaagaaaaacacacttaactattccattaaacgaataaaacccttagatccaacattaatcaactgtaaccacgctaaactgtgttgagtgactaacattggcttttaaatgacttggttaattcagtaatattggatctagctaaaacagtttgatcaacttacatttgaagatataattaatgtatattcgattaacgaagtaattagagtttttctttttcttttttttcaaatcggataaggtattatgtttatattgttgtctacttatagcataatcattagtgtcattaaatgatcatataaagtcttcgtttatcttttgtatttagtcaacatatgcttatgttattttagtttgagctaaaagtcagaacttttaggaagacatcagctatacatgtaagaattgaattttcaatctaaaaatgtcctgtttaatacaactagctcgaaacctaataaaatttgattttactattggaaaaaaattctacaatcttactaaacaatagacctaaactagcattgcatgaaacttttccagatcaaaagcaaaccaaatttgatatcatttcatatctttcgataattgaaaaccattaaagccaaatcgaactgaattttgtataaataaaaccatataaaccgaaaaccctatcctttcaaccttttatcttttattcacttgcatatcgatttcatacatgagctatttagctacataagtgatattattcttgaaattacaagtttaaagaagaatggcattataatcttgtctccaatgagcggtggttccaaacttcttcaaccttttatatctttttctcttaaatcttaagattaaacccgtacccaaaaaagccattatcttctgtgatatcttaccattagtcccgacgtcttcattgcgcttcgtaccggtgagcgaaaaggcaaatgacactttctcaacgtcacaagatcaagttctctcgatcatgactaattcaaaattccccgacttattcgcggaagtatctatgtcaatgacacaccttgaggttgcatgtggcttgttgcttgattgctttgatctcctatcctctatgacttatcaaacttatctatccttctatgttgttagtttctggtctttgaagtttattgtaatccttttaatgcttgataatcttgtaatctttgcttttatgggattgactgaatgaaacacaaggcttatttgataaaaaaataaaaataaaaaaaaaacaaaaaacaaaacgaaaaccaattatatgagaaagatcgaaccaaaccgtataattgtacaatcttgtgaatgttccatgaaggaagctggtgttcatgaatcatgatcctagagaatatttgcttcgaattcactttagtagttaaagctacttatgattgatcccaaaaagcaaaaaaagggcctgaacaaagaacgacgtcgttgacgtagagaagatctcgtgtagtacataaagttggtgttttgctgcagtacacacgaacaccgatcgttagtacattacaaacacttggactattctaaaatttttaactaataattttcttaacaatgttgtttttaaattttaattactatcacatgaaaaccaaagaaaaatttagtttcattagttataattttgaatacgaaaagaaactcggaacctcaaaatatatattctagtatggtttgtaagtagtacacagtacaaacaacaagcattgtactgcttctaaaccaacacaagcattgcaatgtcagctactcctcaagtataaaatcatgtttatgttcatttctaagatgatagaaaaaagcatgaggatattttttcctgggtttgaatgaacatcattgagtgcagcgttgatgtaatttcgttttgtttttcattgttgaatggattaaaagaatttataccagcgttgcgctcaattatgtttttctaattttcaggaacacttaaacaggtatgcggatcgttttttatggttaagtttattttttatcctctattgagttatctttttttttgtcatcagatattatttagggctcaaacgagtcaaaaatgtggaaaattatttacataagtaacgtgaagcggttctttcacgtaatcaatctcttgaaattttgtgatttttgtgatccgtttcatttcgcatggattgatatactttttggatatatatttttttgggacaaaaataagtgctgttatatattcaaatgtataattaggactaaatgtaatatcataatcttatttttttttcttctatttattttgtttctattaatttattattggttttacatatttacttactttctgtaattttacataacaaattaacctccaatttaacttaaagtgaaacactggttttggagtgattaaaactcaaaaggcattcttcttaccaataagccataaccaatccaaagcaactcctgcaaatatccctcctaacagaaatatcaccagcaagttccctaacgcattctgctccggacccttcaccaaatcaaaaccaaagtttgattttttgttacaatatagaacaaatgtgagattacttgtcttaaacgcaaagattgtactcgtttgtatttgcctttaaatattcaaacttgtatgctttatctttcttaaaaataaacaatcaaatctgacacctttaattagtaaaaggtgaaaatagattaccttgtatcctttaggagctatagtcataatgcaaacagtgagatgtccattagtcaatcccaaaacagaaacgagcataatcatccatccttgatcaccatatttcgcagtgaagtagaacgccggaatgaggagataacgtgacaaaaccgcaattgtgatcaattttctattctcaatattgagccatttaaccagtggtgtgtacctcccgaccaaatcccaacaattgtacatcgctactaagacaagtgcgtaccaagcacctagcccgtgttgtcctgtgttttcatacaagaacccgggaaaaatggataatgtacaaacgtagatgaggaataaatttactgcatggtctatgttttgaaacaacagctcttttttgcttagcctttgattcttggaatcatcatcactctgcataggaaaatcatgaagctaaataatgatgaagagtgggaaagttttagaacaaagaaagaatcttgaggaatcaaaaacaaaaagaaaaaatcaagaaacatagattctttaggaatctcttgaaaaaatgtttagtggtgaagaatcttataaaaataaaatacaaaattaagaaagatagattcttgacaacaaagggaagatcttgagaaatctgaagttaccaagtctgattgattttggatacccgcagcagcaagatcagcagaaacagttttggatccttgagaagcggcttttcttcggtaatacataacaatcgggagtttcggtaacacataagcatatagcatcacagatagtaactctatgcatgtggagatagctaagaacatcactgccaaaaagaaaaaaaacttataaacactttggtgattggggttctatcggttttcgaaatttgaaaccttcaaaaatatgaactcacttgccccttttcgtagaccattgtttgatttctcaaaagctgctttggttattagcctaagcgctgatgttagcgcaccagctacagccatacctcccatgtatgactacaaggaagtaggaatatgttagctagtaaattcctcttgtatatgttagctagtctaaaaggatatattgtatctcctaaaatgtataacctgaactagttcagggcacatcagtgataaatcaccgaacattcctccttgaacggtagcatccgcgaggccaaaagcagcaacgactgcgcataaaccggtataaggtccgaatccaccacgtccttttgttgccaaatccaactgttttttttttttaatttaaattcttgcgtctataattaaaatccatttacatatgaaagattaatgtaagattaagacttgaattaagaaacttacaactatgagcaagaatgtggatattgtgtatagaatgtaaccaatcaggttacgttttcgagtactggttttcgattcgtggtatgcgaggatcacgattgctccaaacgcaaacggttggtatacaagtgtgagtactcttgaaggatgataatcctacatgcaagaaacgttatgtcttttttccaactttttgatgactaaaacacaacatcagaattcaaaaactaattttcgaatcttagaatagtcagaaccgaaaccgaaccgggaaaactttgtagtagtaatctgctgtagtgagcatactgttccaagaaataagagaaccaaatccaagaatacagtagacaatcattgcttgatacttcccctgtttttttcagagataaacaagaattttagggtttgaaatttacaaaaacattgaaagattttggttctgagttttggatattgtggaaactcacgcgaagcttctcaggaacttggtgctcgtatatatccgccattttcgaaattgttacagagagatcaaaagaacataacccttttacaagattcaagaaatggatcaaacactggatgatgttattctttttctttttgttgttggagcagaaagctatagacacttacttggaacttagcacatgcatgagggttttgcagagccaacgagtttgttgattatttaaagagtaacgctttcacaaaaactcaaaacaagattcttaatacaaggagatgagcaagtaaaataataataagacttttaaaaggtttttgacagcaaatatggaaggatataatatgagacacagaagaaaaagaaacagaaccaaatagattaaagtaagggcgtgaatgtacgacgcgttccagctttttatgtgtggttctacttatttctcaccattaagtttgtttcaaactctttttttgaagaaaaaaagaaaagaaaaagcagtgcgatacgtatttcttcgtcacagatatagaaacgcacttgaaagaaaaaagcactctataaggtgtggttagaagaaaaatgtagttttgtctaattaatttggcttttctgacgaaattaaaaagcattatgctatgagtttgttttttctctatataaaacacaacatcatcaaacaatatatatacactagaagtagcctcgcgtgatgtgcaaaataaaattagttttaattttttttaatagttttgatatattttaattttataaatatacttgaaatttttatatttttgtttgaaaaattaccttatatatgttaattgatttttacatgtagaaaaagtatcatcaaacacttaaaataaataagtattgtgccgctagttaagaattgaagtagaaaattttgttaaagtgaaaagtttatgtttaaaatactattttactctgtattcttttatatatactttttttgatgcaaaataaaaaaaaacgggacattttttattgacaagaaaactcaaaaaaaaaacttgattgaagtaattaagtaactaaatattatgcactattaaaagagtaattattgaggtatgactaatccatatgtttatttggaatttaaactttacatgaataataattaataattatcataaagcaaaaatatatttatacattagtaactgagtagattattcagttactaagaccataatgaggtttaattgcatagtgtttaatcgcaatttctttgcattcttttacttcattcgtatatgttgatcaaaccccacaagatgctgctctattttcaccaatttagaaatcttccgaacaaaaaccaccaaatgttattgttcagtaatcaaacatctcattgccaaaataagttattccatttccaaatgaagtgaagagagacttcaggaaatatgttctcactatcagtgttttttcactatattatcccttgtattttcttactattttttaatgttagctgtataacctaacaaaaaaacttaaaataaaatgttcaccagatacttatgaaccacataatcggtgcacataataataagattaacctaaatgaagaaatctacaataagcaatataaatcatcatcatttaactatcaaattatcctaatctatcataactcatgatcaaacaaaagactactcattaaacatggtgaaagatataagaaaaatgcataaacaaaaatataaatgatagaattgaagaatccttcacaaaacaaatttcagttaaaaaatgtctaaaaattgcttaaatacaaattcgtttagacctggtcgacccaagataaaacgggtcaaatcttggataatgatatcatgaaaaagtctctagtggtctcactgtattaaaaatgtctaaaaattgttgatctcactatattaaaaaatgtctaaaaaatccttgaatataaatttgtttggaccggattattccaaaataaagtggatcatatcttagatgattacatcattaaaaagtctctaattgtatgttgatcctactgcactaagttaatataacctctggcattgaaggaaaatttctggatgagcttttcttaagcatgaaaatgatatgtgtctactaaatcgatgataattcttaaacctctgttccgtttggcttgaaatcaccatcagtggaaagctaactaaatttctgaatctaaattcgaaagtaaggccttcatccgaattgatatttctgacactttggacttgttcatgatcatcatttctcttcttagcatctacatgtgtgtattccattattttaacttcacataactaaaaacacacacacaaagacactataggatttctaaaacacaagaaaaatcacgtggatactaaatgcaacaaaaaacaatgaaaacactaataaaatttaacaaaaagaatatttacaaccttgataaagtgctaaatatggagtaaatcaggtctcataatcatgcccatattttttgaacagatcagcaaaaataagaaaagcccaagcaaatcaaaaacaaaaatgactgtaaaccctcatcacttaataaaaatggtggatgaatagatcctttgtgtgatgtatcttcatataaaaaaaaaacctgaaaatatatattttgatgataagaataattattttataacatgctaaataaaataaaaatcaatgtaaaactgtaaactactatttataagcttttcttataattcataccttatgtatatcatttcttttcaagtgagaatgaaaatggaaataaaacatagaaaaatatgccacatgtcataaagtttgtataaaatcgcttatgtagtttgaactaatttttgaattaaaaacaattcataaaagtttataaaatttaatgttatttatttcctatatttatccttatgtctattgacgtcacaataatagagagcaccaaatttgattattaggtaaagttagaaaaaaaaacttatcatatgctcccttcctaatgtatcatatagagtttataaattctgaactatgaaacttcttatcttccatcaatattgatatgtgtaaatcaaataaactttcatacaaaacttgacactcaatctcaccgttactttctatacttttaaaacatttatgcattttcttaattcttatatgtcaacgttaatacaaaaaacagggaaagataaaaattttaatatatttttttggttagagaaaagaaatataatgaagaattacacataacagggaacaatgcaagattacgatataaaacaaatcttacaattggagtataatgtagttgctattgaaataacatactataatttaagaacatattgacaaaaaaaaaatgctatcattgagggagaagttctgtcttaggattcaatgttgaaggataaattttgtgcatttggattttagctttgggcttgtctcatatatataaaattaaaaagtcacactcatgatttggccaactaaattcatgtgcagaactctttaaactgtaattacttattttgcaatatacgttaaaaatataagtggagacccgtttgacaaatatacattgcggttttttttaattaattaacattatttaatgagacaaatttaatgggagaggtgggagagtaaaagtgaatagtatttctagaacaaatgtttttgaatatattctaaatgtagaaaaactaaattagttgttaaaaaaaacttaatgaccaattgtttttcattttctgctcagctgcttcttttttatcaactaattttcttcaattcaaatatcaaaatggttacagcaaatatatgcaccatctgatataccctgaggcaattagccaattagctagagcattagagcaaacaaagcgataaaaagaatatacacaaactcatccaagtttgctaatatgcgaaagaagttgtcgaaaagaacaaatacgaaaaatatcggggaaagaggtcactctcaatcctattcttacaatcgacttgaagattgtcaccttaacttgtggcttaatgacatgtgtcagttataggaataatcattctttaacaccccatatacatagaaaatgtaattaaacatcctctgtttttacaggttacaagcaaagaatatgaaagcaacttaacctccaaattaacttaaagtgaaccactgttttggagtgattaaaactcaaaaggcattcttcttaccaataagccataaccaatccaaagcaactcctgcaaatatccctcctaacagaaatatcaccagtaagttccctaacgcattctgctccggacccttcaccaaatcaaaaacccccacattttttttggtgagattacttgtctcaaacgcaaagattgtattcgtttgcatatgcaaattgtaaaataaatagattaccttgtatcctttaggagctatagtcataatgcaaacagtgagatgtccattagtcaaccccaaaacagaaatgagcataatcatccatccctgatcaccatatttcgcagtgaagtagaacgccggaatgagaagataacgtgacaataccgcgattgtgatcaactttctattctcaatcttgagccatttcaccagtggtgtgtacctcccgaccaagtcccaacaattgtacatcgctactaagacaagtgcgtaccaatcgcctagcccgtgttgtcctgtgttttcatataaaaaccccgggaaaatggataacgtgcaaacgtagatgaggaataaattcactgcatagtctatgttttgaatcaatagctctttgttgcttagcctttgattcttggaatcatcatcagtctgcatagaagaatcaagaagctaaagaatcttaaaaacgaaaataataataaaaatcaagaaacatagattcttgaggaatgtgaagttaccaagtctgattgattttggataccagcagcagcaagatcagcagaaacagttttggatccttcagaagcggcttttcttcggtaatacttaacaatcgggagtttcgggaacacataagcatatagaaacacacagagtaactctatgcatgtggagatagctaagaacatcactgcagaaaaatatcactttgatgattggagtttaattctaacggttttcaaaatttgaaaccttcaaaaacattaactcacttgctccttttcgtggaccgtcgtttgttttctcaaaggctgctttagttattagccgaagtgctgatgttagcgcaccagatacagccaaacctcccatgaatgactacaaacaagtaggaatatgttagctagtaaattcaggttaatctaaaccggttagtctaaaacaatattctctaaaatgtataacctgaactagttcagggcacatcaatgataaatcaccgatcattcctccttgaactgtagcatccgcgaggccaaaagaagcaacaacagcgcataaaccgatataaggaccgattccaccacgtccttttgttgccaaatccaactgttttttattcattcaaattcttgagtcaataattaaaatccatttacatatgaaagattaatgtaagagcaagacatgtaatacaaaaacttacaactatgagcaagaatgtggatattgtgaatagaatgtaaccaatgaggttacgttttcgagtattgattttcgattcgtggtatgcgagaatcaagattgttccaagcgcaaacggttggtatacaagtgtgagtacccttgaaggatgataatcctacaagaaacgtaaagttttgtttctttcaacttcttgataactaaacacacaacatcagaattcaataaaccaatttggaatctgagaatcatccgaaccgaaaccgaaccggaaaaactttgtagtagtaatctgctatagtgagcatactgttccaagaaacgagagatccaattccaagaatacagcaaacaaccattgcttgatacttcccctgtttttaaaagtcaagagagaaaacacgaatttgttttgtttttaaatcagaaaaacaatgagagatttttggatctgagtattgagttctttggaaactctcacctgaagcttctcaggaggttggttctcatatctatccgccattgagctcaaaagaacataaacctgttttcaagattcaagaattggatcaaacacaagatgatgctatgttcctttttttttgctggggagcaaataaaggagctagagatacttacttgaaacttagcacatgagggttttgcagagtcaacgagtttgttgattttttaacgagcaaagctttcatgaagattcaaaacaagattcttaaaaagaggagatgagcgagtaaaataatagaccttttcaaggtgtgacagcaaatatgaaaggataaagtaagactcaaaaagaaaaagaaaagattatagaatttaaagaattcaaagtgtgaaagctttttttatgttcctatttttagacaacttgttgacgatatagtatgaaagcaaaactttctttaaaatccttaatcattaaatatccacatatctgtgagatcggtctaaacgtaataaatgaaaataaaaactatgtatgaaatagactcgatgagaatcggtgaagttggataagtgaagcatttgaagtagttgacttagtttttggacatttctagaattataaaattttaatattttaaaacctaacttttatcgtttttctttatctttttattttacgtttaaacaatattggtattaattgcctcgccgaaaaagaaaaagcacaaagttttatctttttttcatataaaatcttttattatgaactggttttctcctaaaaaaaatcatccgtttctaatttaaatggatgaactaattttgttgtaaaaaagaaaaaggataagtgaagcatttatcaaaataacacttcacctcaaatatttagcaaaataaataaataaacacttcacctcaaattgattattacgtgttagtattctcctcttcttttttggggaattagttgcacacaaggattttgtgatcaatgttttgatcggttagtttgaaaggaaatatgggtctaaattacacactacattttgtatttgtaaattacacgaaaatgcctgaaatcttattttagcaaaatatttaaaatcttaactaaataacacctacttcttttttggatcgtaaccgaaactagttctcaatatttgtagatacctaagaaaaaacttttgccactttaaaatgtttacataaaggaaacaatgagttaagttttcatgattaaaagaagtgttctctagtctggaccaacatgacgaaagcacttggccatgaacacttggttaataagaccaaattttaaaactcttaaatataatttacaaatatctgttgaggctctcttatgggcaatacgatttcttatatttttatccattttcgacattattttatagacagatagtaaggagtcgacacaacttttgaacactcctgatgagtagtccgctttttcttcggagtgaaaagattttaatgcttcaaagcctagtttttctcgtttttctttatcttttattacatacttaaacaatgtctctgctgattgtcttgctaagaagaaaagagcacgaggttctatgttttcccatgtaagctcttctactccggactggttttctctcgaagaaaaccgtccgttactagcttaaatgaatgactttattttgctattaattttgttttacaaatatctgatggaacaatgctaaactttaatgcataaaattataatcagtgatcaaacaaaagtagactgttaggatttagtttctataaaaatctatggttaaataacaccatataagattttagaaaatagttaataaaatgatcaaatgggtctaaaatattaactaaaatagatacagcaaattgtggagttgaaaaagtgaaattttataatttggtgaagcatcgaaataagaattcatcacttcaagctttcgaaagttttacgtgttagtattctcttcttcttcttttttcatgaataaacagttaggttcgagcgaggcaccaagcttctcattttttgccataaagagtcagattcatcggaattaattgcacaaaatgatgagaactcagaaagcatatttcttgccaataagccataaccaacccaaagaaattcctacaactgctcctcctaaaataaaaaccaccagcaaattccctaatgcattcttctccggacccttcacaaaatacaaaatcagattaaatatgaaggtagaggtcgtttgtttattatagtgtttgtatttatatgtcaaaaaaaacttgtgttatattttcaaatcgtaaaagcaaagggtataacacaaaaaaattgtaaagataatgtgttttgttttctaaatatgaactaatctaagtttctagatatattcaaattaatttggttaacagcatagggagagtagatagattaccttgtacccgttaggggctatagtcataatgcaaacagtgagatgtccagtagttaatcccaaaatagaaacgagcataatcatccatcctttatcaccatattttgcagtgaaatagaatgccggaacgaggaaataacgggtcaagaccgcaatcgttagggcctttctattctcaagcttcagccatttcaccagcggtgcgtacctcccgaacaaatcccaaaaattgtatgtcgctactaggataagtgcataccaatcacctagtccgtgttgtcccgtgttttcgtataagaatccaggaaaaatggataatgtcaaaacgtagatgaggaatagattcactgcatggtctatgttttgaagcaacaactctttctttcttagcatttgattcttggaatcatcatcactctgcgtagaaaaatcatgaagctaaataatgtttaaagagtgggaaagttgtagaaaaaaagaatgaatcaagaaacatattcttgatgattttttttaaagaaaccaagaaaggaaagaattcttgaggagtttgatgttaccaaatctgataaattttggataccagcagcagcaagatcagcaacaacagttttagatccttcagaagcggcttttcttcggtaatacttaacgatggggagttttgggaacacatatgcatataaaatcacgcagagtagttctatgaaggttgagattgctaagaatatcactgtaacagggaaaacacaaacaaagcaagaaatggaactttaaacactttgaaaatgttggatttgggattaagatgctaaactcacttgctccttttcgtaaactattgtttgatttctcaaatgctgctttagttattagcctaagcactgaggttagagcaccagccatacccgaaccggccatatatgactacaaggaaggagttttatataagctgacttatctaaactgatttttgtataccagagaccttgaatatgctaaacttgatgtacctggataagttcagggcacatcaaagataaatcaccgaccaatcctcctttaacggtcgcatccgcaaggccaaaagaagcaacaattgtgcataagacaatataatgtccgattccaccgtgtccttttgttgtcaaatccaactgttttaaagttttttagagtcttgagtccataataaaaatccatgcagttccataagaaagattaattctgagagtaagacttaaactgatacttacgactatcagcaagaatgtggatatcgtgaataggatgtaaccggtaaggatacgtttcctagtactgattttcgattcgcggtatgcgagaatcatgattgttccaagggcaattggttggtatataagtgtgaatacccttgaaggatgataatcctacatgaaacacaaatttttcaaaatttaaatttaaattgataactaaaacgaaatagcagaattgaaactcgaaccaaaaccgaaaccgaaccgggaaaacttgatagtagtaatctgcgatagtgagcatactattccaagaaaagagagatccaattccaagaatacaacaaacaaccattgcttgatatttcccctgttttttaatacatacataaacaaacaactgaacaagaatttgatcaaaacacaatgaaagattttgggttttttggatacttacctgaaggttttcaggagcatggttctcgtatccatccgccattttttaaatagttatagagagctcaaaagaatgtttcaagattcaagaattggatcaaacacaagatgatgttttgttcttatttttttttgttatttcgagcaaaaaactacatatacttacttgaaagttagcacatgagggttttggttgtagagtcaacgaatttgttgaaattattacgagcaaagctttcatgtagaatcagaacaagattctcacaacatggagatgattgagtaaaatcattatagagttttaaggtttgacagcaaatttgagaagataaaataagactcaaaaggttggcataccctaaggtctgatctttgttgtcaccttttcttttatttccactatgtgaacgtccctttaggtcaatttaatacaaaaaaaaaaaaaaaaaagtttgagatgaggactcaaaagaaaaagattaaagaattaaaagtttgaaagctttagttacttcttctatatatggtcgactagattatagtgtaatccgaatgtatgactttccctgagaaagttattggaaaagtggccaatgcatgcatgaagtcatcttctacgatatatacatcaactaataagctgtgccaattgatatactatagggaaatttactagagtaacccatattttatacataatgacccaaaaggaatgctaaaaatatgagttatttgagtaataattatacctaaattatccttgttttcctttgcagagaaaaacaatattacagaaatgccattactatttaattccagcaaggcaataaaaccacatttatttacgaaaatgccatcgtcgtttttggtaaatctgtggctcttgttgcgacggatttgttatcgatcacagatttgttggtcaaccacagattttttacaacagacttgttttgtaccacagactttactgtgttatgttacgccagattttttttttttcgcagattttttaatcgtgactgatttgtttcatacagtctccacagattttatttaaatttcaaaagtaagaatgttgaaaccaaatctgtcactgatttgttttccggaccacagatttttctttatggtggcaacagattttctatttgcacccaaaaatctgttgtgttataacagatttgttaacctcgaaaaatgttatataggcatgacagagttgttttgtgtaatcacagatttaattaacttgttaacaaatctggtgttttacaacagatttttgttaaaaaataaaattactacacagtcacatagtgataacagatttgtttttagtgatgacagttttgtttttcagtgtcaaagcataacagatttactcatgtcaatgttatggccgatttgtttatgactagaataacctttttagtaataacagactttttttggcagatttatttttaaaatttcgaaattttttgttatatgagatttattagctagccctcaattaaattatttccggtctgattgtatgttaaatcgggtttgactggattttttttttttttaaaaagaaattttcataacgtcacgacagacttttattaatgtcggcagatttttacataatattgtcatatttgaattttaatgaattttattagtcatgataaattctccaagggttttcataaccgtttttttcttcttctattcctaccatcaaatcaattatttgtgaattgatacatgtcaaaatattattggtaagctaaaacaagtcaatttataatatgcaataaaattaaattgtttttctttagtatttttaacatcaaaaacgaaatatgtgaagaagattcttctttatctaaattttgttcaaaattattattttaaaaaaagtttgttctcacgttaactggattttcgtttttgttttaattatgtaatataggttttggttttcttttttgattttataattctgttgaaaaataatttggttttgctgatttgtcaaaattttattggtggagtgacttgtgctttaaaatataaaagatttgttttattttttattttttgttttaatttgattacaattaatcattaaggttatttcgtttttttaccaaagatatggattactacagtttttgaaacaaacgtgtgtcatttaagttatttatgttaagagttgagtcaatctaagcaaatcttactatacttaattgctacataaattaacaattatttgtttaaaccatgcaacattaaatctggcgtgttagtcaaatatcaaaatttactagtactagattagatgatactagtcaaaataacaaaacgatgtcttaattgttattttccacttaatagtactattgttagtctaatgcattcattctattagctagctacagcttcgtagacttcctacaaacacatttccacgtcatacttctcaagccatttaaatgcaagtgggttagaattgtaccccaaactaggtttacagtattattatttttagatttaaactaattattatctttgattataaaattctggtttagtaaagtggaaatatatttattttcaaatcataaactctcttttgcttaaaatattattttttaaaactttaaaaaacattttcataaaaaatgatgttttggatttgatttgtatgaaaaaatggtcgaagcaaacttagtaagtttcatatttttatagtacgtactattgatacatacctttttgattatttttttcttatagttcttcacattggtaattgcttcacaatatgaattagtaattttttttgctgtttgtgttcaccttttttctttacttgttagagctagactatgtgattttatttatattaatattatatgtagtttttcttttatgatatacgaaaaggtatgttttaaatttgggattattgttaaaataggaacaattttatcaaaatctttgattttaaggcttttacgattatatccttgcatacccctgcaacatcagcttttctttctccttctttcttccttcttccttcattttcacagcttctcctcaatcctcgtttcttataaaatggaaaatctaacatcccaaaaatctttattatacaatcttccattgattcaagaacactaaaccctaagatgatactatatagacaacccaataaaaaaaaattaaacaaattttttgagatttagatgtatacatagtgaaccggcttctttcatcttcgactgcgtttacaaaaactaaaccctaagaaaactagtacataatgaacccaaaaggaaaattaaaggaattgtgaagattcattttcttcctcctttatttccatcaaattgtgaatctcgtgtcgtcttcatgtaacatttgagcattaacaaatctgaagcaaacttgaagatgtcgtagcaattcatagcttccagatcgatgagaaattcatgaaaactgtagatgttatggcttggagaagccacatcaattgaagaagaagaaatcatatttgtctactcaatcggagaagataatataatatggaccaattaacactaacccaacacaaaagcttgaaaacccttttgattactttgtaatagtttaacaattcgaaattgagaaggttaaaatctgtattttttcttccaaagacttttagaattggagattttgataaagtatatggaagtagtttctgtgtatcaaatctctaccagatttgcaagacaaaagtatgaaaaaatatgagaaaaatctaaaattatctttatatttagccaccactcggtcacccacgattctcaccaccgtctaaaaacagtcatagacgcatagtcgccgaccgaagctcatcatcgtcactgtctttggcactaaaaaaatcatgtctcattaacaaattattaacaagggtaacatcgtcattttacaagaggaaaagtgcctgtttctgtaaacacttgcgaaagtgctggatcttataagattctagttttttagtccttttcttacaattaattctttaaattttttgcctagggtactcaaaattgtcggaccacactggccaacgtcctaccgtatctgagatgggttagatttttgtcttccttggtttgctcctcttgagatgggttagatttttgtcttccttggtttgctcctctaatctgagatgagttagatgtttgtataaccttttgaattttacatatgtttacttgtttttgactttttgcctcaaaaaatcaagaaatggggtatgattagtaacctcttttattcgcaatggcaagagtgtagactttttcggtttaaaggttactatacattttgaagagataaacacatatgtttaattaatataatgtgaggcttagaacgttctcgagttgtactttgtctaatctcagacctctcaactcactctgttgttcactcatttgtaaaaagcggaacttgaaagtaagaacacacatgaattaacgagttcaggattcaaacttgaatccctacgtctcgccgagatcttctcggaaatccactaagaacttgctcttatcttgagcctttagggttctacaactttctctctctgttacaaacttctctcacaccttacaaagcaacacaacacaaccaactcctttaaagagacaaaaagaaggatctagagttgcccgacacgctcgtgcttgaatcttacacaagtcaggtgctccagctgcaattacgggcctgaattgctgcaatctcttaggcggcttgattgaataaaccattctggttgtctgctcttgttgcttggacgaactcgacaatgtgatgtcatgagagagagctaaagagatctccttttgtttctcaaacttggcgcataaagtgaaccctctaagcgacccagaaactcttatatcttccttgcttttcatttgaacttagaaccctctataccgaatagagtctttctcatactttgtgaatttagaccaaaacgcacaaaactcctccttggtataaagttcactgaactcatcttcttactgttacttgacttccaatctcggatctgtggtctccctagttacttgagaccctgagtcgcttcagcgcttcttgaagcttactcactggaactgtttttgtgaagatgtctgcaggattccatgttgttgaaaccttaacaacctgaatctctccgtctgctatcttctcccttatgaagtgatacctcacgtctatattctttgtcctctcatggtggactgagttcttggacaaagcaatggcattgtgtgaatcacacataacttctactgcatcttgttcaaaccccatctctgcagctaaccctcttagccaaatggcttctttaactgcgtctgcaagggccatatattcagcttctgttgttgacagagccaccagtctctgtaaacccgacttccagcttattgtattcccaccagctgtgaatacaaatcctgtaatcgatctccttctgtctaaatcagttgcataatctgaatcgcagtagcctatgatttcaaatttgtcatctttcttgaaccttagacaggtatcttgtgttcccttcatgtacctcatgacccacttaacagcttgccagtgttcttttgagggtttactcataaaccggcttacaacccccacatgatatgccaagtctggccttgatcctatcatagagtacatgatacttccaattgcattagggtagggaaccgacttcatatactcagcatctcttgcaagagttttctcatttacggctcttaacttgaagtgtgcaccaagtggcgtctgagagaccttactttgatccatcccaaaagctctcaacactctagccacatactcactctgagacagttccaaagtgccttgttctctgtctcttgtgatttccattcccagtatctttcttgctggccctaaatccttcatctcaaattctctgttgagtgactcttttaacttctggatttggtccttgttttgtgatgcaattagcatatcatctacatacaacagtagatagatgtatgatccatcattaagatgttgtgtgtagacacatggatcatacttgcttctttgataacctgagttgatcatgaatgagtcaaatctctggttccactgtcttggagactacttcagcccatacagagatttcttcaacaaacagactttttatgtgttgtcctcatcttcatatccttcaggctgactcatcaatatatactcatccagattcccatgtaaaaacgcagtcttaacatcaagctgttctaattctatgtcaaattgaaccacaatggataaaagatacctgattgacacgtgcttgactacacgtgagaaaatctcttgatagtgtatgccttctctttgtgaaaatcctttggcgacaagcctagctttgtatcttggtggttctactccggaaattcctgcttttctcttgaatatccacttacagcctataactctctttccttcaggcttatcaatgacatcccatgtgtcattctttttcatggagtccatttcttctatggtagcttgcttccatttctcacattctggacttctcatggcttcttcataggtttctggttcataaacttctccatcttctgtcattgttaatgcaaacccaacaaggctgtcatcttcctcaacgaacctatgtggagctctgatctgtcttcgagttctatccctggccagtagatagttctctagacaatcatcatcagaatcactttcctctacttgtttgtctttacttgcagatcttgttgttgaagcttgttcttggtttgacttttctcctccttcactctgattttcatcatctgcaaacaaattctttagctctatgagagtcctttctacttcagtgagctgtttttcttcctcagacatatcattcttctgcagttccttgtacatctgattttcttgaaaaacaatgtctcgagagactacacatttcctgtcttctagcagccacactttgaatccctttacaccatctggatatccgagaaaaatccccttctttgctctaggattcagctttccttgatctgaatgaatataagcgactgatccaaacttctagagtatcttgtaatctggtggatgaccagtccacttctcttcaggaatatcaaactctattgaagagcttgggcttttgttgatgaggaacacggcagtagacgatgcttctgcccagaactgcttccccaaccctgattcacttaacatgcatttaaccttgttcatgatggtcctattcatcctttcagcaacaccattctgctgtggtgtgtaagcacatgtcatgtgccttctaactccttcttttctgcagaatgaatcaaactcctggttgcagaactccagcccattatctgttctgagaatcttgagcttcttgtcctgttggttttcaatctgtgttttccattctacaaacttgctgaaagcttcatctttggttctaatgaaatagatccaagttctcctcgtaaaatcatcaatgaaagtgatgaaatactgacacttaccaatggagaatggtacattcggtgatccccatagatcagaatgcacatagtcgagtttatcctttgtgacatgctttgcagctccaaagctaaccctgtgtgtttttccatacacacaatcttcacaaaactgcaaatctttaatcatgttcttatccagatgacctttactgaccaaaacctgcagcccttttgcaccaatgtgaccaagcctgctgtgccataaacttgtttcatccttttctttgtctatgacattggcttcacctgcaagtgtcgttccctggagaaaatacaaagtactctctttctttccagttagtacagtaagatcattcttaaaaatagtcaaaatacctttctttgattcaaaccagcagcctttatcttcaagagttccaagtaagatgaggttctttaacatttctggtatgtacctgacctcagtgagcaagatagtagatccatcctcattcttgattctgacatccccaattcctttcacttcacaataagtatcattgcccatccttactttcccgcttgcagtctccttgaagtctatgatccaatcctttctgcaggccatatggaaggagcaccctgtgtctagaatccatgtatctggggtgacttcagcaaagccaagtaaagctcttgaaactactagtgcagctgcatcagtgacttgagcagttacagtagaagcctctcctctttcagatgtggaaccttgcttattcctctccttccatacataacattgcttcttgaaatgaccctccttgccacaaatccaacacgtttttcctgctccctttgacttagatctgctcttgttcttgtttggtcctttccccctggtttctgatctgcctttttcttgaacaaacaacccatctgagttattcttgagaagcttaccactatctcccaactccaagatcttagaccttatggcacttgtgatttcttcgagatgaagtgtagtcttgcagtacttcaatgtctccttcagttgaccaaactgtcttggtaaagacatgagcaagactatggcttgatcttcatctgggactacaacctttacgttttccaagtccgatattaacttgaagaaatcattaacattctcctccatcgtcatattctcactcatcttgtagccatacagcctctgcttcaagtaaatgcgatttggaagagattttgccataaataactgatccaggacctttatcatacatgctgctgtcttctgtttgatgacctttctcagaacattgtttcacaggctcaagatgatggtagatctggcttttcctcttttttctttgaggatcttgtcttccagtttagaagttgcagtttctgggtcttggtttcctccatcactaatctcagtggtagaatcttcaacctctgcttcctcttcttccccgagaccctccagaagtcccaacatctccatatgagccagtaacttttctttccacaggatgtaatccccatctccgtcgaacttctccacctctgctctgcccgaagacatcttgagcagatcttcttgctcctaggtagtaacctggaagctctaataccaaactgtgaggattataacgttctcgagttgtactttgtctaatctcagacctctcaactcactctgttgttcactcatttgtaaaatgcggaacttgaaagtaagaacacacaggaattaacgagttcaggattcaaacttgaatccctacgtctcgccgagatcttctcggaaatccactaagaacttgctcttatcttgagcctttagggttctacaactttctctctttgttacaaacttctctcacaccttacaaagcaacacaacacaaccaactcctttaaagagacaaaaagaaggatctagagttgcccgacacgctcatgcttgaatcttacacaagtcaggtgctccagctgcaattacgggcctgaattgctgcaatctcttaggcggcttgattgaagaaaccattctggttgtctgctcttgttgcttgtacgaaatcgacaatgtgatgtcatgagagagagcttaagagatctccttttgtttctcaaacttggcgcataaagtgaaccctctaagcgacccaaaaactcttatctcttccttgcttttcatttgaacttagaaccctttatactgaatagagtctttctcatactttgtgaatttagaccaaaactcacatatagattcttatataatgcatattcactaatttgatcttaaacaagttgtgttagtgtaagctagcttataaagtacttttattcattctagggcgaaaccggcgccaagtcgcaggcttttttcttttaaatgtaattttgttaagttgtatgtaggtattaatgttatttgtcatgattcatgatatatgtagaacaaaagaattcattagaaagtgattaagagctcaatgcatttgttaattttttttaagtaagatctatatagcttttataagttttggaagctaatttttttgcattacgaacatctttttagaagagtcattacaaaacaaaagtgaaaagagttaaaaatcatcaggtgttaattctggtaaggttaaagtcattgtagatttataagaatatgttatatggagttatcatctttgattttaatgttccacatgcatacttgattcatatgttgaagaagaataaaaagctaaaagctatgtttgtttgtttttcaaaacttaaaaattgaaacttagattattggagaatcgaataaccataccatagagttaaatttaattagagtttaaagaacaaaaatgacatcttaagtgtaccaaaatctctaaaccgattgaatataatcaatctttttccaaatggcttcatcaacccatcaatttattcattatcaacacaatatcatcatcatcattaccctctcataatattatactaccatcaccatcatcatcatactatcttcttcatcatcatatcaacataccatagtcatgatagatatcatcatgataataacattatcataaactcgtaattttgtgccaaaaacataaactcttattttttttgccaaaaaggtaatttcgtaattttcccgccaaaaaaagaaacccgtaatttttccgccaaaaaacctaaacctttaattttcccgccaaaaaacgtaaatccgtaattttgtcgccaaaaaaatgtaaacccgaaattttcccgccaaaaacgtaaacccctaattagcttgccaaaaacataaacccgtaatttttctaccataaacgtaaatccgttaaccaatcataaagcttccgaaaatgcaccaacttttaaccgctaaaccagtcgttcaaaaagttttataatgcttaaaactgcaaccatcttattccgtaaactcatgttgtcacaaatgtaggcactgcgtttcaaccagtcaagcctttagataagttttcttagtcatgggcattcgattatccattcagtatcggttcgtatccattcggttattgtttttttcggttataaagtttagtatccattcggttattttaaaatttttgttcggtttcagtttggattcggttcagttccggttctttcggttttaaaaatcaatatctattcggttatttttctttaaatattatttggatagtttagttattttttatattttcatatatttttggttactttcgagtatttttactattatatatctatttttaattattaggtttagaaataactaatatttttaaaaatataattatattttggatatttttggttatccaaaatattttggtttgtatccattcggtttcggttatagaatttaatatccattcggttattttcaaattttttgtttcgttcggtttagtttttttcatcggttttggttcggtacattcgctgcggtttattttccgaggcctaagttttctaaattatgaagtttaggcccatgtttttatataatgtagattttagttttgaaaatagtttagttgggctatgcccatgtcttaattttaattttgttaaattgatggaatgacatggaaaaatagtaagtttttattggtcaacgtaaatgaggtgtattaatcgaaatgttctgattggctgttgattttaatgaggtgtcaagctgtggttaactgaaaaagctgaggtgtcagcacaggaaagacttgtagtgttttaatggtgttgattgtaagcgcacttttacatactttgaaaattacttctcaaatagggaataacataacactagattttatgaagaagataagaatcctataccaataaaaatgtaatatgatccccttcttcccccaaaaataatgttgtgactgtgaaactattgctgatgagaactcagaaggcatttttcttaccaataagccataaccaacccaaagcacatcctacaaatgctccccataatataaatagcaccagcaaatttcctaacgcattcttctccgggcccttcataaaaacaaagccaaaatttatacaaaatcaaaataactgtatatgtaggcagagttaaaatgtttataattgttttggtatctaatgttaattaaaaacatttccttacatttcacaacattgatatacctttttcaaattataacactgtgtttgttaaaaataaagatatatataatcatttacctaaacctagtttaactagtggtcaatgttcatggtcatttagtccaattaacctaaatacaaacgcaatctcaaagaaactatcaaacatggagtagatagattaccgtgtatcctctaggagctttggcaagaatgcaaacagtgagatgtccattagttaatcccaaaatggaaacgagcaaaatcatccatccttgatcaccatattttgcagtgaagtagaaagccggaacgaggagaaaccgggttaaaaccgcgacggttagtccttttctgttctcaacatttagccatttcaccatcggtatgtacctcccaactaaatcccaccaattgtacattgctattaggacaagcgcataccacgagcctagcccgtgttgtcccgtgttctcgtataagaacccgggcaaaatggatagtgtcaaaacatagatgagaaataaattcactacataatctacattttcaagcaacagctctttgttgtttagccgtttatccttggaaacatcatcagcagtctggatatatagaagaatataatcaagaagcaaacaatgtttaagacttaagaatgaaggagtctttaaaaatgaatagaatctgaagaaatagaaaatggtgaaggtttttaaaagaatattttaaaataaccacaaagggacagatcttgagggatttaaacttaccaaaactgattggttttggataccagcagcagcaagatcagcataaacagttttggatccttcagaagcagctttacttcggtagtatttaacaattggaagtttcgggaacacatatgcgtatagcagaacacatagaaactctaccaatgtggagatagctaaaaagatcactgcatgaataaataaaatgtaagcaaaacatgaagttttcaacactaattagctttatagttgtcagatttgagatcttaagaaaacgttaaactcacttgctccttttcttagaccgtcatgtgttttctcaaaagctgctttagttatcagcctaaatgctgatgttagagctccagctacagccaaacccgctacgaatgactacaaagaagcaagaagttatatatactacaaggtagtcaacctaaaccgatatcttatatctttataatttataaacctgaatgagttcagggcacatcaacgataagtctccgatcattcctcctcgtacagaagcatccgcgaagccaaatgaaccaacgattgcgcataaaacaatataaggtccgatcccaccgtgtccttttgttgccaaatccaactgtttcgagttttagaatcagaatccagtttcataaaaaataacaataaaacaaaatatgagagattagacttgaacttacaatgatgagcaagaatatggatgttgtaaatacaatgtaaccaatcaggttacgttttcgagtattgattttcgattcattgtaagcgaaaatcacgattgttccaatcgaaaatggttggtatacgaatgtgagtactcttgaaggatggtaatcctatgaagatgcaagacattcaagttttcaactgtaaatatttactataaaaccaaaacatcatatttcaaaaaaacacaatttctaatctgagaattgtgtgaaccaaaccggaaaaacttggtagtagtaatctccgacactgagcaggctgttccaagaaacaagagatccgattccaagaatacagcaaacaaccattgcttgatacttcccctgttgtttttgtttagacataaatcaacaagaacttgaggaaaaacgattatgaaagattttctgatataagttttgagttttgtggatacttacgtgaagattttcaggagcttgattctcgaacctagccaccattgttactcttcgcaaataattacgatgtttgtttttatatatcaacgtgtttggaaacttagtattatgatcttgaagtgtcaacgtgtttgtggatttatgatcttgatgaacaataaacgtgtttgttgatttcttaattctagttcaaagcttcaaggtttgacgtttagaatgttagaataagactcaatcgtgttaagtgctacaatgttaaaatacgacttacaagctagttagctcacaagtcataatttttaaatggtttattaaaaaaaatcacaagtgttaaattgtcacattgttttgtttttgatcattaaatgcatattcttccatattaagagaacaacaccattacagcaacactagtaatacaaagaaaattagtatacatagtttggtcaatggtatcgttcattagatggtttttaacatttaacataaaagacataaaccattaattacattggaaaaattatgatattaatttaaattttatttgaaaactcagaaaatagtataggtttttaaaaattaataaaatagtctaaaccacccttaaactgtacagtaaacctaaatactaacaccaatccagaagacctaaatcgtcaaccataaaacaaaacaaaatagtctatatagttttagaaaaattcatcatattttgtttatttagcttttcgtttttccgaaaaaatctcttgaatttattgacaattggttatttacaataaacaaaacaaacataagaatctaaggaggggttattggtttatagatttataaggaattggaaatccaaacaaaattatttgttattcaatcattgattttaaaattctaactaaaatcatgtgttattgattcgatgatttataaatactagttaaaatcctttgttattcgcatagtcatttatttttggatttgagaacccaaattatgttttaaatgtaattgaatggatttgaaagagaaaaatagaaggattcaaatccatgggtaaatacatgttatttaaaaatccatatatcttgatttcataattaatagagattttcaaattctatatagatttacaaatcaataaaccaataacaccccctaaaatttgaaggcttttaattattttctatttctggttatctggaaacagttttgtatgaaaaagaaaacttttcctaataaaattcattactgttaatatagctaggctaagtcttgggatactagaacggaaactgaagacaaggtcctttggagaggaaaatctgatgttttcaggactactttctctactagagatacttggcatcatactcgttctacgtcagctagggttccatggcataaggtgatttggttcagtcatgccaccccaaaatactctttctgctcctggcttgcagcacatggtagactcccaacaggcgatcgtatgatcaattgggcaaatggcactgcaacagactgcattttttgccaagggactctagaaacacgggaccacctcttctttacttgcagtttcacttctgcaatttgggtagatttagcgagaggaattttcaaaacgcagtacacttcacactggcaatcgataattgaagccattacaaactctcagcatcaccgtgtggaatggtttctccgccgctatgttttccaagccacaatctacattgtgtggagggagcggaatggtaggcgtcacggcgagcctccgaacacagcatctcaactcgttggttggatagataaacaaattagaaatcagctgtcctctatctgtttcaagggggacaagcgttatgatggaagtctccaagtttggtttcagtcaagaagttaatctcttagctctgtttctttcttttgttcaaaactattctcagctctaattctcaaaaccaatctgcacttgttgtaaaaacgtttttttttggaatataatttaacattattttcaaaaaaaaataaaaaataatatagctaggctactactttgccactggtacacactaaacgaaaaataatggtttttcttgggtatttaatatgcgcgtttacgaataaatagttgaacagtttcgacattttaaagaatttcttaatcctaaattttgattaaaattttactttttcttagaggcttaaagtttctaatatactggtattaatcttgtactacgtacaggaaatcatttaattatgttgatatacgttttgttatatttattttgtaaaatgaatctgtcttctctatctatattaaagaaaacaagttgttgtgagacgtaagccattatggagacataaaaaaaaacagttagaagaagatatacatgttactgtgagataaatatttttttttaaaaagggaagatactgtgatgttggtgtataaaaccgaacctccaaaccaaaaaggaaatgacgagccttaaggaagatctttattaatattccccaagttcggccgtttacaaggtgtttctacagccgagcttaaacttacgtaaatacaaacttcacaagtcaaaactagacttatgcttttgaatccgaagtagaagtttttattgctcttctctgcatatttcaggtgtccttttctgacattcctttgtcagtatttatagtactgcaaggacagtctatagtacagttttcttctcgatgtgggactttctcttgatcaacaacttcctcgaggtgggcttcgtttgatgctgggctcttttatctttaacgggccgatcttttcttccttccttccttgttgctaatttcgatgtgttgggcttttaaacatgttggtggggcgaagcccatatccaacatgtgacgtgaattgaattgatctgaaaatgtaaaagaacaaaattcagatttaagatacgtaacagaaagagagagctgtatatcatcaactagatggagttaagagacaaaacacatgtatttatagtctttagcaaaatggagaaaacgaattaactatcatgaacaaattacatagcggtctgaaacaaagcttccacaaaaatattgggatgggaattgttgatgtgttatgctttaataagtcgtttctaacatttgttttgcttcttttatttttgtgtttttttccctccaaacttaggttattttaagaactatatatgatgggaccgttgcatcaaacacggagttcgaaaagtgcaaaaggccctcaatggattaatctggctggtgatcaatcagtcgagatgatgacttgtttgaaccaaaatatcttcaaaaaacacttgaacatatcaatctgccctatagatcgatccccttcgtgagatgctcgagccaaccttgaagtgtaggatataatttacgtgtggatagatcgctcgacaatataattgttgagaaaccaagaaagagaaaaagacttagattgatcaatataagtttcagactgatcgagatcccaacctcgcgttgtctcgggtcgactccgcataaaattttccaccttatgtatagactatagtataatttaattatgttcttcataatatgttcttcttttctttttttaaccatgtatgaatagttttccaattggattttcccatggtctggatcccaacatgtaacttttggtccttaatttagttcgacctcgtactgctaccgcttaccacaacacaataactataaatttgcgggtgaagaaatagagttaaacatgatcaaattagacattaataacaagaaagttaacaacaacaaaaaaaactcaaaaaatgaatcttcaatgtgaatcattgatgctcataatgttgttcttttttcgtggtcaagagtttatttcatgactaaaaagacatttttcttaccaatccaaggcaactcccgcaaatactcctcctaacagaaacgctaccagtaaatccctaacgcattttgttccggaccctttacaaaaacaaaacacgagttcctttaatacaaaatgagaacaaataagagattgattgtcttgaaatattagaatatatatagtgttaatgcacgagttccttcatagtgttgtttacagcaaaagtcacacgaaatgtaacccttttcaaacttttaacacaaatagctagtgtttcattttcatttttctcgaattcagttacatttacgtttatattaaaatagtttttatattagagaaaaaaaacaaaaaaaattgtttagtattagtaaagctatttgcaaattaaattctaaacgcaaacgaaaataaacaatcatatccacaatctttattaaggagctatatgatgagaatgcaaacactgagatgtccattagtcaatcccaaaatagaaatgagcataatcatccatccttgatcaccatacttggcagtgaagtagaattccggaatgaggaaaaaacgcgacaaaatcgcaactgtgagtctttttctattctcaattttgagccatttcaccagcggtgtgtatcttccgaccaaatcccatagtacattgctacgaggccaagcgtgtaccatgttcctagtctgtgttgtcccgtgttttcatataaaaacctgggtaccagggataatgtcaaatcgtagaggaggaatagattcactgcataatccttcataagcggatttacttcagtagtacttaacaatgggaagtttcggaaatacataaccatttattgtggaaaacatgtaaccgatcatattacattttcgtgtattgctttttgattcgcggtatgagaaaatcgtgattgttccaagctcaaaaggttcgtataccacaatgagtatccttaaaggatgggtaatcctacggagccaagaaacatagagaattcaactatagttttttataaccaaaacataaaacttcgaaaaccaaaacgaaaacaaattggaaaaacgtggtagtaataatcttcaagtgtgagcatattgttccaagaaatgttgttccaactccaagaatacagcaaaaaacagtgaagactttagatatgtcttatttatgttttcttttggaaaaatgtaataatttgaaattataagttgtgtcattattcgtttatgtatatcatagtacaatatatgatagattacgttgaaagagtaagatagatagataatataatgtttgatatagattttctcgtcatacccaacaagtaaacaaaaaaccttactaactgcaacaccattggaaacttatcctcttttcattggtcaatttcttcttttcgctattgtttagtcgaactaaaacgtcattaaatatcaatcaaactacagagacattatttttgtttaacaatacaataacatggacttcaaattagttttagtggaaataatgattagtactaataaaattcgatcgcctgtcgtaataaccaactcagctcaatgtcacatgctaagaagtaagaactcctgattatattttatttttaattctgttgctagattaattaaataaaataaagtcaggaattttgttttccttctttactcttttttttgtgccgacgtcaagaacctagttgaagattgaaaatatatattagatacaatttttaattatatgttatcttttttttttttcttgtctaaattatatgtatcttaaaatcgttaaatcacaatggtttttgtggagtcaagtcaaatgcatatggtgaatgattaggagcatctaacttctggctgatagctatttgacggctacgatgcatctgtcatataaaatggaataacggccagtagttctcatagaccgctattattttggccaacagattgatcgtaagaaaatataatagttgtatacattagtctttttggacacaaaatttttgatgaaaactttaacgaagttgagacgaaaagaaaaaaaaaaaatgtttctcatgaaaatatagttacattacataaggaatgcgtatggtaaatgtttgttttttgaaagttttattatgataaaattattatattagatttatattttttttatttttttgtcgaccgttattaattatttttttattttttgttcaaagatattaattgttgcattagataacataaaatatatataaaaaaccaagatttgttcacaagataaaaaaccaaaccaaatccaaatttcataagatattttctacactaactaaagtacttcaatcgaacgattctgttacaactttgtaatagtaaataagtaattagatttctgagtaaaacatagattatcaaagtcgcttttattattgttttgtttgcaagactcgtgcttacaaatctcccattgtaatcaactatcgttttctagagtttgtttcagtcattcttacactcttattgactactcttattgattattggaatttttttttctttttttttttcaatctttgcttttattcattgaaacaaagaacaattacaagcataagagttaaagaactcaaaaattaaaacattacaacaaaaggtattctccaataccataaaaaaaaaatctaaaattcatcgatttgaagtccatgagagttttaaggcaaagacaaagaaacacaatgcaacatatgagattatagagaatctaaagatcattgttttattttgttttattttgatcgaaagattacagaaaatcaaggaattgttttattttgttgatatatttttgtggtaatatttttaaaattactttttttctttcatataaataaaattcgatagaaattagtatttatatatatatatatatatatatatatatatatatatatatctgtatctcatttattcaaaattatcatttgtgcaaatcggttaataaatgtcgtttatgacactaacgagtaatgagtggtgataataatcaattcggtaatactctcacatttataaattatattaaaatattcaaacggttaactaattatattactttattttttgtgcaacaaactaattatattacatgagaaaaaataatgctgtgagaatgcggtacatgacagccacgtatctctaacatatcctcttcccgaacattcaccttaataatttatatggtcgttgaatgaaatcgaatcaaaaaaaacaaaaatccccaaattaccaaaatcctcggcgacaaagaggagagatagagagagagaaagaggcgaaaataatggcgtcgatccctccgccggagcttgacaacgactcactggcgtcatcgccgagatcggagtacgatagtcagccacgcgtacggttcatgtgtacttttggaggaaggatcttgccacgtccgccggataatcagctctgttacgtcggcggcgataatcgcatggtcgctgttcatcgtcacactactttcgcctctctccttagtaaacttgctaaactctccggtaagttaaaatcattcccttccgattttcgaatcgtgtcatgatgatcattgaaaaccgattagggattttagttggatgattttgatatgatctcttatcgggcctttgtgggcctcgtctaagaaaatcgccacaaggaaatttttagatatgatgagcgaattatttggttaatttttaagatttttttgcagcttaactgatttttatggaaattgggcagatttttattggtctgtggccacaaaaggtctggcatatgatattttttcttcaatcatttaattttgcacgatcatgaaaattatcgactcggaacatttgatccaatgattaattaatattatctccatttcgcaatataaattgttttagttaaaaatacacaaattagtaatatttacttttttaaagttccaaccaatcataaaaaaagattttataatataaataattataaagtatttaaaataatatataatttacataaaaatttgaaaacaatttatattataaaacaaaaaaatggttcaatacaacttatattatgaaacgaatctaatacaacttattttatgaaacagagtgagttcgttagaaataaaaattgggtttagaagaagttatggcgatcactgtcatattacccaaatacaaaattgaatctaaatcatatgatatttttttgttttctttgtcaactatgaattattggtctaaaaaaacatttttgctgtttattaaaatatttttcaaacttattgttggaaattgggcagatattttgttggccatgagattttggaattttgcgggaaagtattcattcaatttataaaaagaaaatattttgattggggaataataatgatgattgttgcgttggaatatttggataaggtaaaagcaacataagcgtgaagtaccagctaccaaacgaagatcttgacgcgttgatttccgtatcaacggacgaagatgtagagaacatgatggacgaatacgaccgcgtcgcacagaatcaaaacccacgcgcctctcgtcttcgtctttttctcttcaccaaaaacgtcgccggagaagaagataacgatagtcgagctagcagtatcagctctctcctcgatagctctgttaatcgggagcaatggttcctcgacgctcttaacctcggttcttccgccgccgcaaccgcggtatctaacggtgggtccggtagagtctttgagcgagttagatctgaagtctcgtcgattgtttctgaagttcctgattatctctttggattggataatttcgatgaaactgctccgccgcatgagcttcgtgatcgtgatccgagagctaagatccaacgagaagtctcgacgctttcggatcctggttcgcctcgtcgcgatgttccttcgccgtatggttcgacgtcttcggctcctgtgatgcgaatatctacaccggaacttccaccaccagtttttattaaaccggaaagtccagaaccggtttcgactccgaaatccaatcctcaaccggaacaagtaatgcaacagagtaatctcccggttaactcgcaatggcaatatgcccctggcccaggccaacaggttcattaccagggtcataccattcaccaatcaccggtttattacgttcctggttcggttccgggtaatcatatggtccagcaaggaaatcatatggttcaaccgggtaatcatatggtacaaccggttcaaatgccgggtcagtatcttcaacaataccatcatgtaccaatgggataccaccaacctcagactcatcagatggctggtccgggtcaagtatatggtggaacggttaggccggttatgatggcagttgatggaatgaaccggacgggttattatggaatgaaaacacccggtccggttcaaatgtatcagcatcacactggtatggttgttcctggtgtagaagaacaacaacaatacagaaccgaaacggattcggatacgggtcgggcttcttagctgtttgaagaagaaatatgaaaaattatcacatccggggttttcgtcttttcattggagtcgttcttattcgttactgtgtgaactgtgtattattttttgttttacttttgtaaaatttatttttgtgtgtaataattttgtattacaaaatataatgaacagtaaaacccaataataataacattataatctatcaatagtgaattacatttgctaaacttttttttgtcatcttattactcgatttatcataataatgttaatggaatataatttgtcaatcatatgttcctcttcgtctttgctggtgacttgtgaggaagtagatatgtcttagaaaccacaccgaattcaatctcatatgtttgttggtgatgtcttcatagttgtaacttttaatacaatctaacaaagcataaaatggaagggaggtaaggatattgtgttgcatcattcttctcacaatcacttcttctttaccaagattgtcgaagcatgcattataaccattataaccatgcatcttaaacacatcctcccctttttttccttttttgtcgatacctttttatgttcatttgaactttctctttatgttcatttgttctacaagtactattcttgtaaaacatgttatttgtttaattgtccctactcactagtcactacctattttactaaaatcacaatttctacttttagctaccatactattcataatcgtaacaactaacacacttacatgaccaaaaatagatttttgtaccatttaatcttaactattaatttgtaaacgatctcactactattgtaacgtttagtccgtccttactagtgtgctccacgttctttctcaggtctatggactcatccctgtccgacgatcggtccgccaaatctaagaggttttaaagacttgttaacgatcctacaaatcactatacgatatttcatcatgttttatcctcatttacatggttctgataatcatttctcggaaggtcacctatcttaaaactacttcgactcaaacacgtttaactgtggagttctccgcataaattaattattttattctctataaaagttatagaaatggtctcgtcattgtactgattgacatcatcaactggagagacatcaactttgggagctgccaatctcagaagaagtttatctcctttacatgccgaggtggaagctctcctctgggcgatgaagtgtatgattggtgccgacaaccaagatgtagtttttcttacagactgttcagatctggtggagatggtgtcttccccaaccgaatggccggctttctcatcgtatttggaggagttacagagcgacaaggatgagttcacaaacttttttctatctttaatctctcgtagtactaatgttaaagcggattttttggcacgaaaagttcgtacccaaccgcttcatattacatctgtaaacaacattcctcaggattggctcgtttgagtcctaattaattttcggatgacaaaaaaaaaaggtctcgtcattgttaattattattctaattgactattcccattaaagcaatcatagagttacttaagtttgacattcataaatttatgcgactatgattaattattgactaagaaaaaattaaatactaatagtactaacattaaagacaaatgtaacgttttacgtgaagtaatcagaaaccagaaatagtcttcttcttcttcctcacacacatacttctctcaccttatcctccgagatcggaaaatatggagaaatccggctacggcagagacggaatttaccgatcacttcgtccaacactcgttcttcccaaagatccaaacacatcgttagtctctttcctcttccgtaactcctcatcttacccatcaaaactcgctatcgccgattccgataccggcgattccttaaccttctctcagctcaaatccgccgtcgctagactcgctcacggattccaccgtttaggtattcgcaaaaacgacgtcgtgttgattttcgctcctaactcttaccagttccctctctgtttcctcgccgtaaccgcgatcggcggcgttttcaccaccgcgaatcctctttacactgtgaatgaggtttcgaaacagatcaaagattcgaatccgaagattatcatatccgttaatcaactgtttgataagatcaaaggctttgatcttcccgttgttctacttggatctaaagacaccgtagagattcctccgggatcgaattcgaagattcttagtttcgataacgtgatggaactctcagagccagtttctgagtacccgttcgttgagattaagcaatcagatacagctgcattgttgtattcatcaggaactacaggaacaagcaaaggtgttgaattgactcatgggaatttcattgcagcttcgttaatggttactatggatcaagatcttatgggagagtatcatggcgtcttcttgtgttttcttcctatgtttcatgtttttggtttggcagtgattacttattctcagcttcagagaggaaatgctttggtttctatggcgagatttgagcttgagttggtgcttaagaatattgagaagtttagagttactcatctttgggttgttcctcctgtgttccttgctctttccaagcagagtattgtgaaaaagtttgatctttcttcacttaagtatattggttcaggagctgctcctcttggtaaagatttgatggaggaatgtggaagaaacattcctaatgttttgcttatgcaggtaaacaaaaaacttggtttcagatcttgttcttagggtttggtccttctatgtttgctcgtaatgtgtaaggtttcgcgtagtttcagttctctttgtaggctcgtagtcatggatgaatgtttaaatgattgcttcagggatatggaatgactgaaacgtgtggaattgtgtctgtggaagacccgagactcgggaaacggaactctggttcagctggaatgcttgctccaggtgttgaagctcagatagtgagtgtagaaactggaaaatctcagcctccaaatcaacaaggagaaatctgggttcgaggaccaaacatgatgaaaggtttgaaaatgatccgttcctatgtatatcatatatgtgcatttgaaagtcatgtaaactggttctctttcagggtacctcaataaccctcaggctactaaagaaacaatagacaaaaaaagttgggtgcataccggagatcttggatatttcaacgaagatggtaacctttatgttgttgatcgaatcaaagaacttatcaaatacaaaggcttccaggtttcactttcacttacccaattctctccttcttcttctcacttgccaatcaaaaggtggagattgataatgaatggtttgattgatatatctaggttgctccagctgaactagaaggtcttcttgtatcacatcctgatatactagatgctgtcgttatcccgtgagtcatatattcagataaataccgagttgattccacgtccgaacacattaaaatttgtgtatgttgtaggttccctgatgaagaagcaggtgaagttccaattgcgtttgttgttcgatcaccaaatagctcaataacagagcaagatattcaaaagttcatagccaaacaggttaataacttatgacccaagtcgtttgaatcaatcggaccgatatcatcttgttttctaaggctcaaaaccatttcatcaggtcgctccttacaaaagattacgacgagtgagcttcatcagccttgttccaaaatccgctgctggtaaaatcttgagaagagaacttgttcagcaagtaagatccaagatgtgaagaatctcgtagaacagagatcaaaatctgtgtgttgtctcgctccttttaccatatttatgtaccatttcaaaataaacgcttacacaacccacaaaagagaataaataatccaataccatagtcaatacactttttctttcatttgtggtggacacaaacaagacataagttttttaatcgttctttcagaagtagcaataaactcttaactttattgttatcagtatgtgtgtgtgtgtatgtatttaaattttggagaaaatgaaactagataatgaggtatgctaagactatagttaacgttaggagagtttctctctagtaatagatatttacattggagatggtcttagaatctctagtaatagatatttacattggagatggtcttagaagttgtaccaatggacacaaagtagctatttttggtataaagtgtttcttgttaaacctcaccttctcctatttccaaatctcttgatcatacaagctaaaataataaagtacacaacattactttgcagtttgctaagaatcttccaactgaaaaagtcaattatttgggactcatcaattggtttacacgtaatgttcatgcagggttggctctgagttcaagctggaaaagttgagcttggaacctcaaattctttcatcatctaagggccgctaatattgtttagaaaggttggtaaagggtttgtaggtggaaggtttgagatgcccctcttttccagtcaaatactatttttattaagttattagaaaaaaattatccgctaggaagagtcattcgggaaccgacgtgcttacatgagaaaaaaaacatttctactcttagctttttttgctaaatggtctgctcgagtgttaaaacttcgagaaagaaatctaatacaaaaagaaggaaaaaaaaagcaataagagatcgaaaagaggctaattatataaaacctttttctagttaaactaatgggttatatatacatttactttggaatccacatatttttaaggccggcaatacgattatctaattcgtatttagatgagaaattttcatttacaaaggaattaaacattttctggttggcctcaatttaaaccgttgtgcaacatacactaaacttcaggtttattcaaaaaaaaaaaaaaaaattatttgcaggtttttatattgtattttataatccaaatgcaaaaccttcggtttagtttgacatttacgtttataattaacaaatttattttgcttcaaatagtaggttcatttagagaaaaatagtaaacgtacgcaaacaaacaatatatgattttgaagtattacaggacatttacatttctgtataaattaaaaagggacataaaactttacaagatcccctgtttgcggaagattactttgtttgtttatgtatctacgtatttagtttataagtttacaaagaatggaagatgccagaaaccagatgtacgttcatctctgcagccgaagccgcagctgcagccacgggatatgaagctgagatcggcattagacatagtccacggctcgaaagatctacatatcttcttggactacattcgtcttcttctacttctccttgagtattgatagatttcttgtttgaacactattaattatacgaatcattaattggtgatgattagttttgaaaagattcttgatgtcacaagcaaaaggacaagaaaagagagttgttataacatataactaatttttaagtacctgctgttgttgaacagatcctatggtgttctgttctggattactcaatacctaatttttaaattaaagaatcaaacgaattgttaattaattgatttgattttgactgcaaatgaaaaatcaagaatctgaacttacagtgacttgttcttgaagaaactttatgtactctacagcttcgttgagaacagaagctgtatctgtctgcaaagagtttagaagacaaatcttttgagcttaaataagaagaaatcaaagattaaacatgcgtaaaatacttagagtaatgttgttttaatttaccttgccaaatggagaaaccagttgctgaagcgcagtgattctatctccgagtttttctttacgaactttgaagcttggcaatggagatagtgtctcgagtctcggtctttttagtaatcgcggtgaatactcatcgctgttctcttctaattcttcactcctctgaaagaatcatcacatcttttgtaatgttaattacctctaagtattagtcacaacaaaaatagttaggtttttatgtttgttacgtgcctttgaagtaagattcttgtagtcttgtgtaatttgctccttagacgacttatggtttctgatttcatgatccaacaaagattcagcttctgaatcgaccaagaacatgttatctaagaatgggaagttttcaaggagctcagatttagcgttaggaattgtacttttggaccatggatccggtagtaattgatcgttaggatcgattaatagtccttcgaagaaactattatgcctacaagaaatataaaagaaagaatataaatttaagaaagttcaatattattactttgtatgttaatgtatgtatgcatgtggacttacatgttcatacaaccatcattatgatcgttaatcttgttatcgaagttttgccatccgaaatttgtgacatcagggctaatctcagtggaacatggcagcgagtagccagagaatactgcggcggtgtttgttggcgagctccaccaagctccggtggagattcctgcgatctcaaactcttccgtcatgttcttaattgtgtagtttactttggaatttaatgtcgaagttgcatgagacatgatgtttattacatagtgtatttatatgtaggcatgagtccatcaaaattataatttaaacggaaaactacaattactaaataatatatctagctaccctcttaaccataatacgtctctatacctattgatgattatgaaaataacgcatctcattggacacactcttgtgttcgtgtttacgttaaattatagagtaatctatttattaaaaatcatttgcaaatactaaatacaggaacaggaagttgacaggatataaataaaataaaaaataatcaaaaagtattttacgttaatatgcttttgtaaaacatgtttgacaaaattaaagaaaaaaaaaattctgaattgatttaaaaggtaagaatattgtaacacaatgcaaatatctctttcgtaaatcagaattatatatttgctcttgataggctaaactaaatgtccacgttgaacaagttttattgtttaataaaaacacgaatatctacttttttggaatgatttgaaaatattcatgtttgaaggaattagataaagcaaaaaggatatttggattttggtgaaaggttttctttttaaaatggttaggtaatctctatttatttggttttcttctaattttacgtttaaaaatgtgcacaaattaataacattagactacagaaataccgatttcgatttaaaaaaaaaaaatattatttgacaaaatcttgcaaggaattttgaaacagtgtggtagttttttggagagaagtccactctgaagtattttagtgcgtgtttaccgggactgagcggatcagccgatagagtttatcaaaaaagaaaaaaaaatctgaaacggtttggtctggtgttaataataaatgttgcaaaaaaaaaaatataacaaaaaggacataaaaggtgattcgaaataaatgaataagaggaaattcacatgaataaataaataacaataagtcaactgttgacatataagtacaattagtaataggtaaatacgttttgtgtggattaagtcataccacccaatcgaattctcttgggttttaggggttgtcttcatttttactttggaaatgttcccaaatcttcttttaatatacatacaatatatgctcatgtcatctgatttgactccttaaccacaattccactattagttaattgaaatatttggttaacctatctaatctcatattatatgattattatatgtatatctacttttttcctttctttttataaaataatcagctttgcggtctaagtcaatttggcttcgagggatacataatccctaaactaaacatgtctaactacttaattataagtttttcctgttaaagtaagacttagtttagtttgaaaaagtccatatagtactatcgatctcatcataatttttttaaatcatgtcatcaaactgtagttgtagagtttaagatttgattagatttagaaatatagtgtattttaggtttggtaactggtaagtgttctttaatttatagagatcaaagtaaatttggatgtgacttccgtttgatagaatctttaaaagctaattaaagtttcggtcaaccatatgacgtttaaaccttaagcacatacaaaaacttctttgttgacttataggacatgacaattaaacgaccatggtctaacctcctccttgtcatatcatgaaatttgttatatcattatacctaattaaaatctaaagtttagattatctcgcgcgtggagtgggaagaacacttagaaaaagtgaagcgattaacaagaagaagaataaaaacttataaaagtgttaatggtttaagtgtcctcggcctttgacctaatcacacgtatattttttattatcttcacgatctatgttaaaatatattgttcactatagtatgattaatttatacatttgatgtatgtatatgatgtatgtatgtatgtaaaggataatcagtagtgtgtacgtaatatagactagaagtgtatgataaatattaattgaactaaactttaagaaaaatctctatgttacctattctatatcaattagaaaatgaagctaaattaattgcatatcttacttgaatatcatgtgtcttaacatcgattttcttttacattcctgacatcaagacctcaaaaagacagaatctcaagccctcattctgattcctaagatgacaaagtaactttcacatacaaatatgttgagggactactatctgcatgaaactgtgacaaatgcatggttgttgttgttatcaatccattaatttctgtataaaagaaaatttgatattaattttagttaaaatttccaatcaaaactctttgaaaagttgtggtatgtcatctaatttatgatggaacaaaggttaatttgatcacgaagttggtgtaaaactgataatgggaatgatgaggacgggaatgctcagaatcagaacatgaacttacaaagtggtcagctcgaggacgaatatataatgttttgctaaagagccagccaatatattggttaaaacttgaaactgaaattagagataaccgatttgatcagacaagaagagaaggagaaagacaaagtacttggatagcagtaattataataacatcgacatcaacagattacaacgcaagtctttcttcattaaccgagcttggcaagaacattgttcaaactcgagacagtttctgagtaatacttctcagcatctgggctactctttgatctcgccgcatagtccaacttccacataagaaaatcaacaaaacaacaatctcagattaacccaaacttaggaagaatcttgtgcataaaaaaaatcaatgcacactctaacttctttaccaagaaaccgctagaaaacaaaaccctaaagaaagaaaaaacttacgttgtcaatggtttggaaaagctttgcggtgagatctttaaggctttgcttctcttccttaggcttagcggagataacggtgttgagatcgtaacggaggtacgatgctcttaaacggagatcgttctgaacatagggccaagcttttttgtcgataaatgacttaacgttgatgatctctttagcagaatctttggctctagctgcagcttctgttggtgacaatggttgtatgtaaaatctatctttcaatgccaatgaaaagtctcttgcttggtctgagttatctgttccagctgctcacacacaaaaaaacaaaaacaaaagcagaaccataatcaatcaaacagaaccggtctctataatctaattactaaaacttttatcttacaaaagtgattaaagatacgtttgataaaaacctaaattataaccatgcaagctataacacaataatttcgttttgttatctccttaaccaaaaaaatagtattagtcattatgtgaaatttaattaaattagttttacttacgtaggccaccggaaggaagtggaggaccaccaactttgatcggaatagcttcggcgaaaacagctttaacgaatgaaccaccggctaaaccagccgccacgagtccaatcactgaccggcgactactttctggtactgacacgttctgctgagccctgatcacaagtccggttctctgagacccaaccgagactcttgagatgttcaaacggtttgagccgttgatctgtaaacttccttcaaggacagcctgagatgctccacgtaagccagccatcgaagtcactgcttgagccattttttttttatctgctttgaataattgattagtgaagtgttgagttataatttttggtgtttggttatgtgacaaagaataccttatctgattcacgttgttacttagattactcggatatggttttaactactaatatgttgacacgtggtttcttgattctcagttttgccacataggattgagatcgagtgttcccagaatgcgattgtcacgtggctgaatgacgtggaaattgaccaattcggttaaacctagtcaaagttaattgaaaaccggtttcgataatatctaagcaaattgtaacttaaatccaatccaacttgacaaataaatgaaatcccttattgttaaaaaaaagtacaaattgaaaaatagataattttggcctcaatttcaattttggattttgtacatagccattaagaataatttggtcaattcaatctattaaagtttatatgatccacatttttaatttcgggtgggttaggaataatagtcacttattcacgaattcaaatacctaatcatgtttagcatccaaagtagacaatcttaaccgttcaacaatattggtatcactacttcattttggtatctaaatatgagcatatttcattccaaaaagaattataatcacaaaaataataataataaaaaaacttataatcacaaaaaaaattacaccgtttttactattttacatttttgttactactttacttatatttaaattacatacacacattaaaacacattattttaatcactaaataacaactaaccaataaaaatctcaatcattatttataaaaatttaaaataaaagaaatattttataaatttataatataaatataatcaaatacttaattaaaaaccatataagattgacgacctgaaagaggatggatcaaatgcaactttgatggctcattcgttaatggagatgtagaaagtaaagcaggttgggttgttcgggatagtaatggaagttatctactggcgggtcaggctataggaagaaaggtggacaatgctctggagagtgaaattcaagcgctaatcatttcaatgcagcactgttggagtcatggttacaaacgggtttgctttgaaggagataacaagatgctgtttgacctaatcaacggatccaaggtacattttggcgttcacaactggatacgagacgttcattggtggtcaaggaagtttgaatcaatccatttcaattggataagaagacatcacaatgttccagctgatattcttgctaaagctcctctccaaaaccaatctttattccttaatcatttttgggttcctaatgtaataagctatgctttacattgtgactacactgctgatttataaatcaataagatgatgatgacaaaaaaaaaaaaaaaacatataaaaccgaggcccgctgtaaaccacgggttgaatcctagttaaagtaagtaataactctccaaaattatcccaaaatcgaatattaactgcgaatcaaactaaaaacaagaatttgaaacttttaaaacccttcattttatacaaaataaaagaaaaataattttataaaaagatttaaccataaaatagaaaccaatttgattaatatcttacttttttttctttcccataatttatttagccaacaaaaagtcacgcaaaatatggaatatcactagtgttaatggaccgagttttaagtcaattggctcaaatggagcctatactttatataataataatttaaatattaatggacaagagtaacgttacaatgttgatgggcctgaaagttaagtcaattggcctgagagtaagtatctaaggaaaaaaaagattattgtttaatgctgatgggcctgaaagttaatattataatcgaggagaagagtaacgttacaattttgacaagagtccgccgatctgttttcaaatattcaaacaacaggctcctccttcttccttcctccttcctcaattcttaaaatctcccccattaggaaaaaagcaagaaccctaatttcccatctcagattcagaaaaaaccaggtctgatttctcccgggttcttaagaaatccgccgccgatctcgggattgagatttggatcctattgacgagcctaaggtgaagcaatccatcgaagatgccacttcgcaaccagaatcgcgctcctttacctagtccaaacgtcgtaagccttcttctttcttttattttccttcttctaagagagaagcggagattgtaaaagtcataacgatatttttcagtttaattgtttgatttagggttttgttcaattgagaagatcttgtgggttctcttgagaaattgattcataaaagtctgtggctttacttaattttgttggtttttgaactatgtttaagaaaaaggaagcgctctcaagtattccttttgacaagcgaaggaaggagacgcaaggtactggaagaagacaagtgctttcgacagtgaacagacaagatgcgaacagcgatgtgggaagcacagaggagtgtggtaaagttgagtttacaaaagatgaagtgttggctttgcttaacgagagagctaaagctggaaaatttgataccaaggtttgtgaaccgaataaccaattggttgattataggagattctaagaaaaaaatcactttaatatgtatttgcattgtggtactaatagggtaagattgagcaaatgacggatattatcaagaagcttaaggtctgtgttagatggtaccaacaagtggatgaaactcatgttcaagacaaggaaaatctttcttcttctcttcaatctgcagagaaaagatacagtgataaaggtgaattttagttttctagttacatgtttggttctcacatcgttttgtgtacactgaatatggacttgatttctcattatttctagagttggatgcaaagaccaaagaggaagagctacgagcaactataacagagatgaaggagaacatagaatcacttcaggaaaagctgtccaaggagaagttgagtaaactggtaaggatttatcgctcaaagaatcgtttatcattgtgcaaacttatctcctaaagaatcgtttatcaagtttggtgactcttaattggttatgactactaggatgcaattgaaaatcacagaagagaaaaagattgtagagttgtagctgagaagcttcaggtttctctcagagaagagcttgacaaagttaaagaggaaaaaatggctgcgaagcagaaggtacttaagatttgcttttcgctaatgtgttgtttacttgtttcattctctgttaactcctcttagctcttggctcaatcttttagttgttgtgttaactggaatgttttctttctttctaggtgacgtctctagaagatatgtacaagaggctgcaagagtacaacacaagtttgcaacaatataacaccaaactccagactgatcttgaagtagctagagaggctcacactcgtgctgaaaaagaaaagtcaagtatactggagaatcttactacactaagaggtcacagtaaatcactacaagatcaattagcatcgagccgggtaaatatccctggtctacaaacgtgattcttgtatttcttaatttgtgattgatttttcattgcatcttacttcgtttatcttccccttttgtgatcaaggtttcacaagatgaagcggtaaaacaaaaggattcattgctgatggaagttaataaccttcaaagcgagctgcaacaagtccgtgatgatcgtgatcgccatgttgtacagtcacaaaagctggctggtgagatactgatgtataaggagagtgttggaaagtcatctcatgagttggacattcttatagccaaatcaggatctttagaggttagtcaaagtcgacgtttcacatccttgccttatattttcaatattctgacaatgtcaatcttatgctgcaggaaacatgttcgttgcaaaaagagcgtattaaaatgttggagcaggaattagcttttgctaaggaaaagcttaaggtattatgcgatcaagtacctttggaattttgattggtgatctgccaactttcagatactctttagtttgccaattgtttctttacactgacatacgtttatttgctttctacagatggtggatttatctatgtctcatacaatgacagaatttgaggagcagaaacaatgtatgcatgaactgcaagatcgccttgcagacacggagcgtcaactttttgaaggagagttattaaggaaaaagcttcataacaccattcttgtaagaaaatgtcgttttggaaacacttttcagttatagtatgactttctttatggccgctaagcaaagcttttattccaggaactcaaaggaaacatacgcgtgttctgccgagtgcgccccttgctaccagatgatggaggacgccaagaggccagtgttattgcctatcctacatcaactgaatctcttggtagaggcattgatgtggtccaaagtggtaaattcagcaacccaccttattactttgctcaattaggatatgtctgtactagagtttaatacatttttattgccttgtgctacttgggggtctcaggtaacaaacatcctttcactttcgacaaggtcttcgaccacggagcttctcaggaggaagtattctttgaaatatctcaacttgtgcagagcgcattggatggctacaaggttcaatatcttccttgttttgactttcttgtagatagatacctaagatgcaaattctagttagatagaagtagtatttgactcatggttattgtccttatgtagttgaatttattaagaactcctgtttatgtgaagcagactacactttgactgattcctttgttactgcaccaactcttgtttaaatgagacagacatcactttgactgattcttctgtcattgcatctttctcaaatctttgtggacacaggtttgtatttttgcctacggtcagacaggttctggcaaaacctataccatgatgggcaggcctgaaacaccagaacagaaaggactgatccctcgatcactcgaacaaatattcaaaaccagccaaagtcttagtacacaaggctggaaatacaagatgcaggtaaatatttctccaagaatgttctgacttttgttgaatgctttcactgttagcattgttttgatcgaattttaattgtaggtctcaatgttggagatatataatgagtccatcagagacttgttgtctacaagccgaacgattgctatagaatctgtgcgggcagacagtagcacatctggaagacaatatacaatcacacatgatgttaatggaaacactcatgttagcgacctgacaatagtagatgtatgcagcattggacaaatttcctcacttttgcaacaagctgctcagagcaggtttgtctataagttttgggaacttttttcttcaaagagcatggcttttgagaatattgttacactgtcgtttctgtatagttacatcgtaaacctcttatttgtaggtctgttgggaagacgcatatgaatgaacaatcatcaagaagtcatttcgtgtttactcttaggatttctggtgtgaatgaggttaatatcttttgtctttcaggtttatgttttgtgttgtagatttatttctcacttatgaaaacaccaacactctctcctatttcagagcactgaacagcaagtacaaggtgttcttaacctaattgatcttgctggaagtgagcgactttcaaggagcggggcaaccggagaccggttaaaggagacacaggtttttgcttttaaaatacggtcttctaagttattcccataaattttttggactttccctctaatctttgttgtttccttcaacaggctataaacaaaagcttgtctgcattgagtgatgttatatttgcattggcaaagaaagaggatcatgtacctttcagaaactcaaagttaacatatctgctccaggttagataacatttttacttctgaatcattatgcaaataatctgtctatctagctctttctaattaaggagaatcatttttaaacagccatgtttaggaggggactcaaagaccttaatgtttgtgaacatatcacctgatccatcttcaactggagagtctctatgctctcttcggtttgctgctagagttaatgcatgtgagattggaatacctcgcagacaaacttccgcaaaactcctcgactctcgcctaagttacggttaacactggtggttcgagtctctctttcatctgtataacaacaacaacatttgttttagaggtttgtaatttctgattgtggttttgacttatatttttctgtaccaagctcgatggttcatatgaatcgggtactttaccaagcttgctgtcttggcaatgttgtgtgaggaaatctcaaatctccctgattggcatttttagagctttttcggttatgtaattgtcttttaggacataactaaataagtttttgctttgtttcacatagttacaagttacaacataacattactggaactaattgttgaagtcaacgaggataaactatagtgatggaagaatcgtcaacagacaaaggcaaagacttgcttgttgcagagtgatcagaagcagaacctcctgagcgtggatctctagagtctttcatggttcgaagaagaaacccagatcgctttggaatcggtaaagtaacagtgaagctgttcatcatcacaagaatgtcatccattgaaggtctctctgaagaatcttcttgaacacataacaaagcaatgtgaatgcatctgatcacttcatttgtctgaaaattccctctcattgcttcatctactagctccagtggtgaattctccacccatagcttccacacctgcagatatttataatgtttcagaaaacagtatttaaaaagagtttttgattggttataaaacagtacttacgtaggtcactaaatctccaagaccatcttcttcatagaagctactgtttttcttgccggttatgagttcaagaaccaagactccgaagctatagacatccgatttcaccgagtatttcccgtggatcgcatactcaggagacatataaccactaaagagagaacttgtttaatcataatgggaaattgaataactcattgaagtgtcaagatcacaagaggaagaaacaacttactatgtaccaacgattcttttagtattggcttgagtttgatcaacaccaaagatcctcgccataccgaaatctgagatcttcggatgcatgtctgcatctaagagtatgttactagctttaaggtcacggtgaatgatcgttagccgagaatctcgatgtaaatatagtattcctcgagctatcccttcaatgatcttgtaccttctttgccaatccaaaactcttctcttctcattatctacaaacaaaaagaaaacaatctgattaatccgaaaaccgatattttctttagaggaatgagtgatgatttgttataccgaaaaggaagtagtcgaggcttttgttaggaacaaactcatagacaagtattttctcttctccatctaagcaatatcccaagagcttagctagattcctgtgttgtagctttgcgaccacatcaacttcgttcttgaattcttcagctccttgtgtcgatccttgagatagtctctttattgctactgtttctccagttataagctgaccctgaatgagttttacacagaagcattaaaccttttttgttttgttaaagtatgactatatgatcacaagtcacaagacttagttaccttataaacttcaccaaatccaccatgaccaagcttgttactttctgagaacttatttgtcgctgcttcgattgcgctaaactggaattgcagtgtttctgttgacgtaataccatcttcatctacattaagaaaggaaaattctcaagaaagtttcaacaaattagactagaaaatggcaaaactcgctcaattctgttttggttttacctaaatcctctgtttcagcactgagcttattattccttcttcttgctagtaaccaacacatagcaccaagaagtaacacacagacagaaaccggtacagcgatcgcggtaactataactgtcaagttcttgcctttacctaaacacaatttcaaaaacatatgaaacaaaacaacctttttactagattatgttctatgagtttcaagatttttaacctttttctgaaggaatattcagtggtggtgcagtcaccgttgacgaaggaggaggagccatcggagccgcagctatagtttcattgtaaaatggataaagctcatatctgaagctacaactcggagcgattactctcccgccaacgcttcgatcacaacatctcggcaagtaattaatgacttgtctcaaacagctctcacaatcttgattagtcaaatccggagtgcactgcacaaggctatagattgtctgaaaaaccgtgaaattggctttctccgtagcgaactttctcgagctcaaagcggctttcaccgcaacatctatgagcagagcaggcaaagactcgttgaatctgctcacttgattctctgtgatgttttgcttgttcgtcaagaaaacaccaggtctaattctcatttgccctacgatgctttgattagagtatcttaccatacactcatcgtaccaaatcactgccactttctctcttggacacctttggagcgtttcgttggctgcaaacgcgacacagtcacggcagatttcggctgagacatctccacggcagagaaaaacaccatagactctgttgctatcgttctcttcaccagcggctgcgttatcaaaaagcgatgcataagctgcgtttggagaggagagagatgaaagaacagttcggagattggttaagtaactgctgtttcttgagtacgttgttgtgtttggacatatgtggtagagataagttggatctgaagtaactgtcttcaagatcataaacaagaaaactgagaacagagaaacagaggatttgaaacaagaagacatgtttttgttttctttgctcttcttcttctttgagtttcttaatataatcttcattggaattagtgggattcaaagtctaattactacagttagtcattgataattaagattgtttaaatcaaattattatgttcaaacttcaatattccataggttaggcaggcctgtctagataatgaaattaaaatgtgctgttgtaatcattgacataataatatgattaaaaaacatatttggtcaaaggtttcggggaatcataaaatttataaattcatcaaaatagtttttttttgtcatcagattttatttagaactcataatagccaatcctgagtaacattgtttacaaaagtgatatgaagcggtttcaagattgtttgttgagtataaaatattacatggaaatgttgattttttagttctaatttgttttgttaaaagaaagagtttaaagctttggagggaaaaaaaaaaaagcaagttcaaagtttttttttttttggtcgtgtcgctaaatttgttcagtttcttctgaatctctataaattttgttgactatggcaaatagtttgcgaacattgttctcagtgtccactcatggtgtctttttgaacaagcggtctaggtttttctctagtagccgaaatttaagggtttgctctcatcaatcaactgaatccgtcactgttaatgtttctccacataacggttagtcttgttaagaatttgtacctttaaagttttgacttttgtttgcatttatcttatcaagttatcgtgtacgcaaggtgtttgttggaatgcctctgagaatatgcagtgaaattcctagattcgtatcagtttcgtgtataaggtctgacatgtgtggtattatgatgcttgggaaagatgttcatgatctgtatatgatttaacagcattgtgatgaacgaatattgatgacaattgttgcatgaaacattttacgctattaaagagtccggattgtgatatttagatggtggaaagatgttatatgtgtaaaggtggtgactattctatgtaaatgattgttgctgatacttcttgtgttttgttgtaactgtcaagattagagacaagtagtggaggtaatgttgagaaaggttttctaagatggcgaaacggaggaggaatgtaccatcgttcggccctaattgattcctcggctctggttgagtttggagcagtggttcaccaagaagctatattgggagcagaggttcatataggatccaacactgtaattggatcatcagtcaaaattggcccttctacaaagatcgggtaacggttttgcttaatgtcttatacatgtttttgaagagaatcttgaaagaatctatacttgtctacaggtataatgtttcagtcagcaattgtagtattggtgatttatgtgtcatccataatggagtctgcattggtcaagatggtatggaccaagtccatgttttcttctttatcttctgagaattggcattgaattgagattggtttttaactgttcaggatttgggttttacgtggatgacaacggaaacatggtgaagaagcctcaagtaagcacacctagattgctctcttgaatctggataacaattgtgcatcacttttatcctttgttctgtttcttgctctccctagactttaaatgtgaagatagggaatcgtgtggaaatcggagcaaacacatgcattgatcggggcaggtaacagaatatttcaagaactagttccctgtaaagctcttttctagctccatatcctttactatttatgcagctggagagataccgtgatcggggatgatactaagatagacaacttagttcaggtgtctcttcgattctatcttgcaactcccccatagatcacaagtaaatgacaactgagatgctattctgtttacttaaatattgcagataggtcacaatgtgattattggcaaatgttgcttgttctgtggccaagtaggcatagctggatcagcagagtaaatgcttctaatcccagcaaccaaataactattatgttccgttgattgaaactataagcttctcgtcttttcgacaattattttttgtaggattggtgactttgtagcactaggaggacgagtagctgttcgagaccatgtctccattgtatccaaggtaaaaaaatagaaacataattggagtaatgaaattgtgcagtgcttcatctaaatccgtttttggtttccgactataggttcgacttgctgctaatagttgtgttactaaaaacattacggaaccaggggattacggcggttttcctgctgtaagcatctctctttctcttcgattgagtcttcacttccatctgattccaagatcccaagtttgctttgattttttatcataagccagtataaaaaaacagagccggactctgcttttgcttccgataaacattgtttcatcttacaaaaaattcttattcaggtcccaattcatcaatggagaaggcaaattgttgaagctcagatttcgagcaagaggaaaccataacttattctgtttgccagactcaagaagactgaggtaatagattgaactatctgccaattgctttgcgtttttacttttaccaaatgatttctttgatatgtttaactcaaagatcatacatttaatgagaaaaaccaaactcccaaatccaagttacaaaacgtaaagaaagcaaaatcattcaaaaggaaagtaaaatataaagagaatagcaaataacaaaccaatcaatctttctaagtgaagtagactggacaccgtttatggttaaacttgggcaagatcaacccgtctcttccaaccacgatgttgcaattagcgtgcatcctatgatgcttactgatccacctatggagtttaaaccgaatagtcgaaactatatcgagcctgaaacccacggttccttgagcccgatcattactaaactcggtccagcggttactgtttaccgttaaggaagctcctgtaagcgtcccggtcacaattgttgtgttagtcggttgctggaaaaacgggtttagcaatgggatcaatccgacccgttgatctttgtagtaaatggaaccttccatggaatcaaagtaaacacccatatgttggttagggttaagtatggttacattgaaagcaattcttgcgttttcgactccggtaggctggtctagaccttgtaccacgaagtcttggatatggaaccgaggtctatgagggcgtaaactgagccaaagtatgaaagcaatgacgcctacaaagaacaaaaccaagagaaacattgcgcagatgaatttcgatatccgggttgagaggctttctctgacacggtgagcgtagtagctagcggaatggtgacgcttcatgggttgggctcggggtacgggactggtgcggatcgggatagttgttcggtctggtgtcattgtgctttgatgatttcctggcaaaaaaaactatggagattttgagcatgaaagttttggagtgtaggagttatgtatgaaagaagaaaagtaaatagttcttgaagtgtttggagaagaaaggaatcagattacgtaaagtgaacacgttgtattggtaacttttgtgttttttcttcatcgtatttttgattatttacaagagaatcgtataatacaacctattcaagctattatagattatttaaatatatatgaggttttaattctttattgtattccatttccaacggtgctcgcagtggacatgcaagatgcaactatgtctgggcaaataaattaaaccgaatgtatcgaactaaaatcgaaataaaaataaccgaatagaatcaaaaattggaaactaatcgaatggatactaaattctataaccgaaataaccgaaacagaatggatataaacctaaatattttgggtaaccaaaaatatcctaaatataaatatattttcaaaaatattagttatttctagacttaataattaaaatacttgagaatatatataaaatagtaaaaatacttgaaaatatctaaaatatatccgaaaatatccaaaaataaccgaaatatccgaaatatttaaagcaaaataaccgaatgaatactaaattttaaaaccaaaaacaccgaaaccgaaccaagctttcaaaataaccgaatggatactaaactttagaaccgaaaaaccgataaccgaatggatataaccgaaaccgaatggataaccgaatggataaccgaatgcctatgtattttaaaatccaagaaggctcaatagggccaggcccaaacattatgggctggttttggttttagactttttcagatttagtgaatcttctgaaaaaccattcccaaaaacaaaatagaaagtaagatagctaatacattacattattctttagttaagtcaattgactaaaagagagatctaaacaattataatttgagtctagattttccacagatattttgtatttttactattctcacgattgtaaatatcaaaaacccatggaaataggtcgtttagttaacacttaccacataatgcggaaacgttagttactaaaatccaaagttgatagcatcttctctcatttcaccgtcttcgttagcagtctccattgatcttgaaacacgtaccattgatacgattatggatgtgttcttcgagactcggagtggttccacattcgagattgaattaggttattgggatacagtgttggagatcaaacaaaagatcgagaagtatcaacgtatcccagtttccaaacaaacccttttattccaaggcaatgttcttcaagatcatcttgatatcgaacaatgtgtgatccttaaccactctcgtatccaactttccatctcttctcccgaccaaagccgtaacaacattcaagtgttcaaaaccgagcaattcccacagtcaaattcaacagaacagaccagtaacggtcatcatgaatcaacagtgatgatcccaatgagcaacaacaacaacaacaacaacccgaagaagctgagagtaatggtgttgccgaaatccgggactaggaagattccggtggacgtgaacgcaggggataatgttggagagctgaggaaagagttggctaagattcaacagaggtttcagttaagtctgcctcaagaaggctatttctttatctataaacagaatgtaatggatgaaaacaggtcattccggtggcaccgtgttgatcaaggcgacacaattgagattttcaacggaagtgtttccggtggctcttaataccctataatttcgaagctcaagtctttgcaatctcctcatttcttgtagcttacagtctttttttttttaagtttcttgctttcttctaaattgtattttcgtctcagagctttctacaaatatgcttaagaagatctatgacaagtaattttagtattttaccaaaaaataataacgagctgaaaaagagaaacttgtgtgttattgacttacctcttgacaacaaaaaaagggatcagatcattctccaaattaactttccaaccgggtaatctaaataacattttaaaaatttctggataatctggcatataacaagatgtataaataagatcagaagtttataataagatgtcaaaaaaaaaaaaaaaaaaacatgtataatgcttaaattaacgaggctttcattgacttaagaaacacgtaatctataaggtttatttgggccaagcccaaataaagtccatttgatacgtgaattgatataaaactagattatgcagttcatcagactctccatttgatcttgaaacaccattgatacaattatggatgtgttcttcgagactcaggatggctactatcaacagtattcagataaagcctccaaacagagtagaaggtttctctggcaaatgtcaatacactgccgtttcatctaatgcagcaaagaaacaaatgaaaatgggcttcgcagtacataagcccaagacacaaatatggaggcaacggtcactcagcttcaaatgttcaagagtctggaagcttcccaagtaatgacataaacggagctggcagtacggtaaagacatttaccctcaagctggagaatcagtttctagcccttgattgtgagaactcaacttgatgatgacacatgtcttgtctccttagggtttagctaagtctcagtctttgtatttaagcaagaacaatctcctcttgtaaagttaagcaaactatcaatgaaaacttaaaaggattgattttgtcttcagctacaagttcgagattgaattgggttactgggatacagtgttagaaatcaaacagaagatcgagaagtatcaacgtatccttgtttacagacaaacccttttcttccaaggcaatgttcttcaagatcatcttgatatcgaacaatgtgtgatccttaaccactctcttctcaaagtattcgtagatccttaccgtaaccctaatcacgacaacgatcaaatgcttcaaaccgaggaatctccaccgttaaactcagccaaagagatcgttaacgttcaagattcgccaattatggtgagaagcaatatgaaagtcgcgacgagcataaaggttgagaacaataataacaacaatgatcagtgcttcgaaccaagcaatctccagcgtcgttaacactcaatattcccctttgaagcttgtgaaggttgaagcatcgaaatatttggataatctccaaatatctttcattagtatctacaatatatttgttataacaaaatatttttgttataagtttagataattatataagactatattagagtttatctaggttttggttttcttttttttttaattaatgatcaatggtttttataaaattatttttagagtttatctaggttttagcttagacaataatcattgtttcatgcaattgttgtttaattgaggttttgtaaatgagcttaaagtcattcgtagtggaacgatacaactatgatttttcgaacatcttacacatgcatgggctctgtaaccatgtggcttaagtcacaatttaggattaagaaaaaactatgtagcaaaattgtacttttccatacgtagaaccaaaatacaacaaaaaagttatgtggattttatcttggaaaaaatgttgttttatatgcgaactttaaaataatggccatttaatacataaattttttgtatgatcaaacaaaatatgataaaaatgttgaccggttatttcacacaaatgttatagttgaccaggccaaaatccccataacgttatcttgtagtaacggatgcgataactctgttagcacatgttaattagtttccgttaatacccaaaacgacgccgtttcatttaaatcgaaacatcaaaatttccaaatcgattttgaaatccctaaattctaaaattaaaatcaaatccctaattcctaaattctaaagaccaaatccttaaatggccttctttttgacgttcctccatgttcatcatcgatcttgctcctcctccttcacaaattaaaacgaacaactgctgtcaatagtcgaatgtggttattcatattcaaattggttctcatgtgtgtgtgttcctaacattttatacacaagagacaacaaaacaaaacaaataaaaaacaatggaaattcacctaaaattaatcagtgttccaacatgatgaaatacaattatgagagtgaggaaaaaaccttggaagaacgggattgagatttccaaagaagaacatgttgttgccatgtgatgcagatggaaaccaaaaattgtttgcaaaaaaaaaaaaaggaaacacaaagaaggaggaagcagagatagcgagaagatgattaagaagatggaaagaagtaggaaggattagaaaatcatgttcatagtaatcataacctttagcttttccgatcaattctcaagataatttcaaagtagctaggaactagggatttgatttttagaatttagggatttcaaaaatcgatttggaaattttgatgtttcgattttattgaaacggcgtcgttttaggcattaaagaaaactaattaacatgtgctaacagagttatcgcgtccgttaatgcaagataacgtcatggagattttgccctggtcaactataacatttgtgtgaaataaccggtcaacatttttatcatattttatttgaccatacaaaaagtttatgtattaaatggccatttttttaaagttcgcatataaaacaacatttttttcattttatcttatttgaaagtttaacgaccatcattattggtatcttcatctacctcaaaagtgtcttatttaagatacttttgttagttataagacatgtctcttaacataagagttgttttaagagaccattaataacgatgctctctcctctattcttatagctttcagtgtttcttgaagtcaactccatcactcaaagtttattttttgtttcacagctaaaagctcataattggttacacgtttatataaatatttttttattatataaaatacttaatttttcccaaataagatgaaaaatatcaaaatattattcatatatttcatttcattcattgtgaggtagatgaagtagaaaaaaaaattaagctaattttgaatacactaaaataaagatgaacaaattagataagcatcgtgacgtgttgctttcagagtgattttctaccatttaaaatattacccaaatgcgtgttcaaaaaaaataaaattattacccaaattctactatagactatttacatattttggtattagttttaatacatacatatatcacacaaattaaaaacaaatttataactaaaaagtaaataattagtcaactaacttgcatatttatatttaacaactaatatgagagctttgtctattttatttcattgacttaagaagaaacacgtaaagcaagaaggtatatatgggccaatcctaaatgagtgaaaatatgaaaccagagtaaaactttatttacaaaacaatcactttctctgtctccactctcttttcttcatcattctctccattgatcttgaaactccattaatacgattatggatgtgttcttcgagactcagagtggcgacaagttcgagattgaattgggttattgggatacaatgttggagatcaaagagaagatcgagaagtatcaatgtatccctgtttctaaacaaaccctaatcttccaaggagttgttcttcaagatcatcttgatatcaaacaatgtgtgatcctcaaccactctcatatccagatcttcgttgaacctaaccctaaccctaatcccaacaacgctcaagtgcttcaaaccgatatatcttcacctttaaactcattcatagatatcgataactttctagattcccctgtttcgacgagcgtcaagtttgggatcaacaacgacgatcacgtgcttcaaccggagaaatctacaccgtttaactcatccaaagagatcgattactttcaagaataccctatttcaacgagcatggagcttgtaagcaacaacagtgatcaagtgcctcaaccggagaaatctacaccgtttaactcatacgaagagatcgattacattcaagactaccctgtttcaacgagcatggagcttgtaagcaacaacagtgatcaagtgcctccaccggagaagtctccaccgttaaactcatccaaagagatcgattactttcaagaataccctgtttcaacgagcatggagcttgtaagcaacaacattgatcaagtgcctcaaccggagaagtctccaccgttaaactcatccaaagagatcgattactttcaagaataccctgtttcaacgagtatggagcttgtaagcaacaacaatgatcaagtgcctcaaccggagaaatctccactgttaaactcattcaaagatatcgccaacactcaaggtccgtctgtgaagcgtataaaattgggaggcatcaacaacagtcaccaagattcgactatgagggttaatgacttaagtaccctaatctaacacagctaaacttggtttaagcctattacaatactatatggcccatgacccatcttcttccttattaccttgtaaaatgatccattgctttttcttttaaatgaaattgactctaaatttcataagaatatgggtgtttcatactcttataacctagattcttatgtaaacctcaagtagaatctgatttggtgttgtggctgcgtacaaacttttatgatcttgaaattagggtttttctatgcaaatccatatgaaatatacagatatatccttagtaattgaatcatgatgttgtggcggcgatataacttttatcatcttgaaattagggttttgttacaaaaatttatatgaaatttacatatatacccttagtataatttgaattagtgatatagtacaaacctaaaaacttttctaaagttctattttttttattaaattatgatttttgacgaattttatttttttccaatgaatgtggttctttagctgaaaactaatataaaaattagactaaaatatgaaccaatacataggagaaaacagagagaaagcagaggcctttatcgaggagagctaaggtggtccgtggcaaaccataaggtgagcccttcgtcttgtctatgagttttgttaaatgaggggaagagatggaattttctccacaaaaatcacccaatatttctgtggagattatgatatttttacatcttcagtaagaaaaaaatttaaaatcatctttctacaacatcaatggtaaaatactataatttttaccacttctaaaacttcagaaagagatgataacttgacttgagtaaaaaagaaagaaaaaggaaaaaaaaagcagagtcctaagattatggtgcgttcatcatttaccttttttcaaatcgattcactcacatcagatataataaggaagtagtgattttaatcactacagtagattattttcttctctatctaacaaggccaacaataagtcaataacacaataaaatcggaaacttgaataacaagttacatttaaatcacaaagagggaaaaccaacctaaacaaagaacaaagaagaattgcttactttacacaaccgttggatcatattggtaaaaggaactaacgacggtgaagattcagtgacgaggctttcattgactataaaatgtcccatattcagtgacgatacttttctcgctcttcactttcttcttcatcaatctctccattgatcttgaaacaccattgacagaattatggatgtgtacttcgaaactcagaatggcagaaagttttgcattgaattaggttactgggacacagtgttggagatcaaaaagaagatcgagaagtatcaacgtatccctgttcccaatcaaacccttttcttcggcaatgctcttgaagaccatcttgatatcggtcaatgcaagattctccaaaactctcatgtcgtactcttcgtccttccagaccctaatgacaacaacgatcaagttcttcaaacggaggagcaacctcctataatcggagatctcatttacggtgaggatttgcctttgacaactgaagttgttttgaatattcgacctttttgcccagttcaagattctccggtgagaaacaacgatcaatctccaccgtcagacgcagcaaaagatatcatcaaaggtcatcaagattcgccggtgagaaacaacgagcaaactccaccgtcagactcggttaaagagaacactaacattcaagattcgcctgtggggaagataatactaacattacgggtgatgccatattccggcaagattaaagctgcgaagaatcttcattttattacgtacaagacgtatagggtgaaaatgctgagacaagagttggttcagaatgaactaagggatcatttagatcggcctcaagatggtgattatttcttcgtacacaaagggagagtattgaacgaagatcagtcattcgagtggaacagtgttgctcacactgatattgttgagatcgttcccgatccgtggctctattaggtcaaattcaagacttttggttttattagttttttcttttagggtttatagtctttcttgaagtttcttgctttgtgcaaagtttgcttttggtttcacaactttcttcatatattctaagacatgtaattacctacaaagaattttgaaatgaaaattgttcttattgaataatgaagatgaattaagctaagtttgtagaattgatatgcgaattggaaactggagaaagagaacagatacattcgaatttttatccttttttaaaaacattacgttggataattttagtaagatttagattcttcgaggaggctattgacttagggaacacgtaaccgagaaggttaatatgggctaagcccaagtgagttctatttaatacgttcattaaatgatataaatactaaacaaattctctacaaaacaatcactttaattatctctctttttcttcatccgtttctattgataaagttatgaagtttctcgtcgagaatctgaatggttcatcattcgaacttgaggttgattacagggatacactgttagtggtcaaacaaaagatcgagaggtctcaacatattcctgtttccaaacaaacccttatcgtcgacggcattgttattcttcgagaggatcttactgtcgaacaatgccagatcgtccccacttctgatatccaactcgaagtctcatctgacgatgataaccctaatcacaacgactgcgatcaaaagccgcaaaccgagcaatctccagcactaccattggtttcagcggaagagtactttgagagacaagattggcctttgacagcagaagagctgagacagatttatagttatcggcctgagcatgaaggttgagagcaaccacaacgatgatcaaaccgagcaatatccaccgtcgtcgttgcgaagatgaggcttgacgagatctttggaaacttttcattattatctttggaaatttttcattattatcttcaatgtgtttactattttttttaagttagtttagataattatagattatttacattttacctaaggttttggtttctattttcttaataaatagctcattatttcccattatttcatgaagttatttgtttagttgagattttataaaaagggataataaactaataagcatactagattgtaactcgtgttggtagtagaattttaatttttaaatatttatttaaagttggatcattgtttgttttataatacagctttaatcaatccatacataatacaaaacaaagaaacttagaccatgcacatagttggtattcataaagtatcataacattttttactattaattttaatgtttatttattgtttgagaatttttataatactgataataaatctgttttcagtgatgagatccgtaatgatatcattgaaaaaaaatatttgcaaaatcgaaaatacctgctagcatcggccactacaacgataccggagacagtccgattgaagagaacagttaaaagagaagcgcctccgacgtagatataaaggagtgtgagagaatttgcgattaaggttccaagggatctgaatttggaagatgattctcgttttcattgaaaaagaatcgtatcaagatgcactgaagaggagagaagagaagagcaaatgattttttttttctctcctttcccacaaaaacgcgttgccgactaatcacaagccgccaaatcatcaaaaactagtatcagaagtatctctccagtgatacgacttaggcccaaatcagttgttttacccattaatttaatgttttttgggtttctgatactcataaaaatcctactatgtacatggtcttacccttattccattgtcggtgaaatccttcagggtttatgcttttccagtgctaaaatcgcatttcaacgaaaccgaatccctaatgaatgaaatcgcatttcaacaagtagaaaaaagtgataagactagggctttttattcaaaatctcggttttgtttaaattcgaaccaaatccgaccggtttacttaattaaaccaaattgttaaccatctctcagaagcaaacccctaatggcctaatccgatgatcgacctagttctcaatgtacttgaagattttatattgccttctactcacaatattatgcataaccctattataaagatgatcaatgtttatatacagctacaaactttttcattctcacttagtctcattgtattatcaatcaacgatatagctctataccatattgaactccgatgatcggggctataatcggagaagagagagatgtaacaaacgtttattatcaactcaaaatattgttacaaagcttaaactaaaattagttacattcacatcttatatactattcacattaatcttaaaccgaaatctagttaactggagttaaccaaattaaaccagtccatctatcccaataattcattcattcatacaattttatgtacaaggttaccaaaagaatcaaagagaaaacacttggcttaagtaagagtataacaataaacagacaattaaagaagaatcatatgcatatataatttcaccatgtgatattgaattatataaaaagaaattttcacagaagtggacgaaaaaagatttgctctcaccgtttgtcaaagtgagaactggttttcacgttttgtcttttcattcaatttcggaccaaattaccctgggaaaacttaataatggcacaaaccaaaccgtgcagcagttcgtatcggttaagttgacggcgtaaaccaaaccctacagcagttggtttcggtttagttgatgcggttcagttttgaaaaagacaaaaaaaaaaactgaaacgaagaaacccgagaaaacgaaaaagagaagagagtaacggagagatttgagagagaatcagaaagcgaaacgaaattcagtatccattgcttcaaaattcgacataacttcgaattgttggatagttgaattgagccactgaactcccacatccggggaagtgaaagttactgtttttctcggcgaagccaagagaaagttactgtttattccggcgaaatttgaacctccggcgagatagcatctttagctatggctgggaataaagctaacgacgaagtcccgaggaagcagcatggtccagggaaggagaagcgggtattaagagtttccccgcggagaaaacgctctgcgacaaaggcaacggaggaactgggttagaatctctaatttaccgtttgttgtctttgggtgtatcagaattgtaaagcttgtttgattaaggggttagaatttgtcggaatttagcatatctttaggatgaaaaattgagaagtagaattggaaatctctgtttccgccaaaaatatgattttgagttataatctggaaaatgtctgtgtacgtacactacttcggtttgcttaacagtatatgacttttaattgcaggtagtccaagtgttgctccgactgaagatcttacagttgaagagttaccaccaagactctttgctttagaccggtacccttccgagacgaagatgaacgcgtactctaaaccggagtacatttctgacatagcaaatgtactaaaggggaaaccagagatgcagtttcttctcgattctccatttggggaactttttaaaatacccaaaaacaaggcatctttcaatgctaagcttgtccttagactaatatgccgtaagttagtgacaaagaaggtgaatgagatgtggattgtattcggcggtcatccaatcagatttggattaagagaatttagtatcttaactgggctggaatgtgggaagtatcccaagaagaaagacgttgatgatgttatcagtgtgaaacctgagtgtgagagtgtttggaagactctgtttgatgagaggttttgggacacggttccaacaattgctgatttggtgagctggctgtaggaggaggaaagcatggaggggtggaagcaactggcactatctctttttattttggttgacggtgtggtagcggcccacagtaaccccaacaggcctacttcgaagactgtcgagatgactaagaacctggagttcttctgcaaatacccatggggaagggtgtcctttacccgtactttggggaggatagcaaatttccaaactccttacgatgctcaataactaataaggggtttacttgtagggtcttatgcactccatggcttctcattagctctccatcttttagctttcgaaacaatcccatcaattgctaagctaggacctgatgatgtacctaacaggacatttgctgagaggtctatccatcgtcttgcctctctgcgagcaatccggacatctcgcattttggagtgtgaggctgctgatgaggtgtgttaaattgtgtatgtacgtacataataagtaaatgtacattatctatggttaacatacttatttgtgtaggttgaggtcaactatattgtgaaaccagctgataatgtttgtcctccatctctttcatgggatgatgaagttgatgatccaagggttgattacattgaggcactgttgatagatgggcaccagtggcaggaggatgaatgggttggaggctatgctagagtaccaaagcagttgcgcccaccacaactagaagagacaggtaagtataagtataaaggttgtttacaaatttttttggtattgcacccagaagaaaaccaattaatagcagcaactggtctattgtagatgttaagaggaaacgaaatgcaccgggcccgagccctaaagaacctgctatgaaaaaacagatatctgaaatggactgtgataaagaagagaatgctgaggattgttttggagagcctgtgcctgagaggtttattgttgaaatgaggaggtctttcaaggagctggaagaccaaatgtatcaaatgcatgaagatatgaaagactttgtccgtgaccagatacgtgctgtccttgatccaaaaggcaaaaggccagaacaaaccataccttcccatgattcgcgggaaccacctacttctatggataaggcaccggttactgcgaagaagccatcgagaaggatgtctacaaaaggaagcactgaaacgagaaagtcttcaaggctgactcgtgtttctcatgatgtggacactcctgcactttctgttggctgtaattccaaagaggaagatttggatatccctggagtacataccactgctgtcggcggaagaagaaaaccttcaaagccgaagaaaaatgtttcttttgctgttgacactactgagctacctgattccaataaggaagatatgcaaggattcattgatgaacaggtaagtcatgtacgtacattgctaaatattttataatccatatgtataactgtactgtctgcttcgatacagtatggcgctaataatgaaagtgattttactgcaaatgatggattggattcttcggccgctgaagaagagatattagacactggatttttaatagttccttatgctggatccacacaatcccatctggtatgtcgtctactaatactcttaacaatctgtttaaatggtgtacgtacatattcgcttaagaagttagttaaactatgtttcaggatagaggaaatgttgttgttggtaagactgtcttcttaggttcaatgtctgggactgtctatgttacacaggaagagaggcctgtggaagaagctactgttgacaccgagatggaagaagttccatctaatgtgtatgcaagagtttcagaggtagatcttctggtaatcgttatatacagatttccatgactatatgcatatatattacattaatttctccacttatctaacgcttaactctatggtagcctatgtttcaggataatggaccaaaggatgttgctgaacctggcttagttggtacccatacaggggccgatgaaatagctgatgctgacatagagatggtagacaatccatcaggtttaccttcaacatctgcacaggtatgtgttagtcacttgttctttttccatatgtgtacgcccataagactttgcaaattatttttgtttcataaagaagcaagagatgccagtgcatcgactgaagctaatggtagcgagtcagaagaaacttatgagccttctgatggagatacagctcacgtacctggcacaagtgtacatacatttttgtcactatgttttgtgtacatatatattgtttcatacattactaaaaagtttctttccgatgataaattctacaggttgaggcggcaggagaatccaaattagtgacagagatggaagttgaaatacctgagaagacccacagtgatcccccgtcaccatttcaagtagttaacaatgtaagctaactcttgcaacaaataaaatgtactatttactgttcaaatgtataaaatttatattatgcaggtcatacgggagttggataccaaagccgttggtgatttggctgcagctactgatgtggaggtaacaatttgtgtgttttaattcctattttcgaaatagcatgcataggattatatgtgtacattatatagacttgtgtacgttaacttggacaggtagtcatggaagagccgggtattgtcgaggggtctgtaggaactgaggatcctaacccagggtcagatgaagcagacaagaccgatattcctaaaaataatgtatgtacctattttaaaaatagaaaaacgtatgaaactgttgttgacaatcatatttgttaacaggatgaatcagacaatgctgttgctgtcgaagcaaaagaagaaaaaaaatcgtccccaaaggtcccaaaaaaagtgaagaatcaacttgtctatgaacaggatgatgtccatcctcatggttttaaggcaaaaacagtcttggtgcccgatgtaccaaatcaacagatagaggttgttatcagggctgaaaatgtctcatacaaccccctggacatggttgacccttcaaaagtagaggaattcagcaatatcattaaaggaccctctgtgtaagtacattatattaaaatggattatttaatatctcaatcatcatttttccaagtcttaaggttgttatcaaatatttttctggatttacaggattcacactcttttcgggtttcgcaaagtgcccaacgagttttttgcgaaccttctaacacctggtgaatgggtcgaaagtttggtacgtttcatttatattcgtacattccttgttataaattgtacatagatgattaaatttttcgtggaagtgtacgtacactgatatattttttgaacatttcagcatttagaaaagatggcaatgttgatgtggcacaagaacggggaacagatgataacaaacagatgtattgtattggacatgatgctgacacatctacttaccaagcgggtgggcgacttcaagaagtgtattaataagaacgggttcaaatagggtaaattactgtccgacattgctaatggagttcacataaaccgtgaacccaatatgaagtggctgaaggatgtcgatgttgtgtatgctccgatgaactggaagagtgaacattgggttgctttgggaatcaaccttaatgaacggctaataactgtgtatgacgctttaatatcgcacacgcgggagtcggctgtgaaggcgagaatgactcctatttgcgaaatgataccgtacttagtcagagcgatgtgccaggatgtattgatttctccgtactcagttgaaccttttgagtatgtgcgttgtcctaccgttgctcaaaacccaactacaggagattgcgggtcatacacgatgaagttcttggagttgcttgcgtttggacaccctttttcggaattgacaaccattcgagaagcagatatggttttctaccgtcagaaatactcggttgacatctacgagcacggcaagcgggaggccggtactgtgcacttgctttaatcgtccaagaacaatattctggttctttgcaaccaattattatgaacaaacctatcttagatatatgattgcaactacatttaatttggagattgtcagaagttaatttagtgtcctctatcatattgtcgtacacatcgttcacttctaattacataatgtaaatgtgtacgtacatatctatatgtctcgtacactgcatattaactttataacataactcaagtgataaattgatttgacagccaacgcttactaacacaagtatgacattcatttcaaccgtaattgccccaaccaaattcacagtagtggttattaaagtgaagaaattactgacgatctctgactatctcatttcaaacatggttaacccgactcttcccgacgatttactctcgaagatagctaagaacctggctaaccaatgctggtccgaccttggtccactggtacgatccggcactcgtggaagagacattgtctaccgtccggatgtcctcaaagatgccaatattctcaccttgtgtaactcgcccgatgacttccaagcttgagggggccacaatccctccggatccgctgatgaaggccgacatcgaccattttttttacggtgttttgcagctaataatcccacggcagtgtattacgaaggtattcgtgttctaacgcatgaacgaaacatcaatggagccatcaggctcttacagcgtcatgctccagtacgagcaaatgcaacagttacatgcgccattgtattcatatgtgctgggtatgattatatgggcgacttgtttctacagctcttcacccgcaaccattatccattggactcggttgccactcgaatttgggtgatgagtttcttcaaggaaataaagaagtttgaccctgcatacaacaatacatatggtcctacgttctcttatcctaccagccatggaattagtatgcctccttgcgccttatattgttacatggtatcaggagctttccaaaacgtttgcaaccgctgttacctctgatcgtgtgccaggcgtgttagtcaaatgctatagttaaaatctaaagttgaatatttttcagccaaattcgcatatgatatttagttcccgaagtaaatgtaaatttggatattaaaatctaagcgtccacaactacgtacacgtgcatctaccaaataatacttaaaggttttttgtttgtctcggaaaactagatatgtacgtacactagcatgagatatcaactctaacgtacactaaaaaataacacattcaaacatatgaggtctttggtttgtctcataaatggtgatatttatgaatggacgtacactgatagtacactacagcgtacactgtttgttgggtaaatgtagaaatgtaaatgtggacgtacactacaacgtacactgtttgttgggcaaatgtagaaatgtaaatgtggacgtacactaaaacgcacactaaaacgtacacgtctagttttaagctgttattaaaaagtggttgctcataacaacaataacaaattatatatggaatactattacgttgatttgacaatatgaatacacatcatcacttaatacctttgcaataaatacaaccataacttacccaaccatatcttcaatgatgcttatttaagtgttggaatttcattttgttaaaacaccttactcctaaatataacaaacccaaatattcatgatgatttgcttgcgaagatagccaagaaaatggctgacaaatgttggtggtacctcggacctatgttgaaatccggtcctcgtggaagagacattgtctaccgtccggatgtcctcaaggatgcaaacattttcagcatgtgcgacgatcccgatgacttctacgcggtaggccacgatccaaatgacatcaactccgaaggtcgctatagacccttcttcaaacggtgcttacaagctggtaaccccacggctatttaccatgaaggactgcgtctcgttacacatgagtctgacattcagggagctatcctacacttagagcgaatctccccaaggaacgccgctgcaacccttgcatgcgcaattctttacatatgtgctggtaatgctcacatgggtggtgtctaccttcggctcttcggaagcaaccattatgctttggaatcggaggaggcacgtgacatttgtgaggaggtgctagaagatataaagaaatatggtaatactttaaaatacacatacgctaacagtttttcgtacccggaatgtggtgacttaagcactcctgaatgcgcagagatgtgttacatgagatcgagactcttcaataatctttgcaaccaatgttacatctggttgtgtgctaaacggattagccagatcctgtagagctcacattcgccacgatcctgtcatatttataagtttttcatgcaacaatatgtgagctttttacgttgattatcagtaatggaagtttgtttttaataattatcactttgtaattgattcaaacatactagctcaaactactctaatatgagacatcattaacacaaaataataataaaataataaaatatctacgtacacggtatatgataatgtacatgtggtatagtttaattccaactataaagattacatagtgagcgacggtatagtttgtaaatgaagacgaaagaaaatttgatttgacgtcgtataacacatatctagaagatttcgctccatattaattactcgctgtcaaatacacactagaagtgacctccatcacactctcattaatatctctattagacatacacggttcccgagcaacgtactcaattgatttggcagataaaataagtaagttaatgtttatttgaaaagattgttagtaaatgcgttgacccctaatatagcactatacatgaagccatattgttccacttatatgcaatacaaacagacgttaactcaaccttctgtaagaaaacgtaatgagtattttatagacatacacggcgcgattatgagaggtacacagtagtttgtttaaattaaaagttactaatatgatgcactaaatatacatccacgtcacccacccacttacattgatgattattcccctctttaaaactcatgtcaaacacacttagttgaatacacgaatccgtctaaacctcctcgtttgaaaaacaatgcctttcctacctccgctaacccctccaaccgagttgtacctaggaatccaattgccaaaccccataagcatacttgtcaactacctccccgtcagccagactcccatagagacgctaaggaacttagtcaacagttgtgacatcaacacccttgcaatcgatgaattcatgacgtggccgtcgttactccaaccggagtctaccttccggccatacttcgagctgcttgtagaacgtggatccatcccggcggtttaccttgaaggtgttcgccaagcgagcaacttcgtgacagtagctcagggcctttcagtcatgacaacggtcgctttatctgatccctttgcttgcttcgcaaccggtttgttccttacgtgtactggtaatcacttggatttcctcccgatcagcgaaaagttctgggaaatgacacccacccttgaagctggccacgcggttgcagagatggtgatgtatcacatcagccagcttcacactgaaaatgctcgccgctgggaaaggtcttggaggtttgtccacccgctgagttgcgtagggcaatgcacgttccatcatggctgcagggtttgttttttctactggtacgccagggagattgctatattctgtgtatgacggatgcacacatattttgcaacacatgtgtatgcttcgttgaaaaaattatgttttttgattcgttccagtttatttatcttatgaatttccctttatataaactgcctgtcttttttatgtttctggcttttgaatgaattacccctttaagtattactagatgtcttcgtgtacgtacactatatagtacattaaacttggtttatcgtacattgggaaattgcgtacacaacataagtataaatctaatagtttttgatgttgaaggcaccaaaactaatacacgtacacgatagcgtacaccagaaactatacgtacattgcgagaggatttgaactataaaacaaggcatgtacataaaacaacaaattagattaacatttaaacggaaacaggaaacaacaacgactgaaatgtagtttggttcttatggaaacaacaacaacaactgggaaagaaaacttaattgaaatgtagtcttatattatattaaaacggagaataatggtgtaacgcctgtgtcccgagttagggagtaacccagatcttacaccagccgaattcgaggacgaattcagtttaaggggggtagacatgtaacgaccgcgtcccgcgttcataaagaggccaagttgttttaggagaaaactagaccatggtcaagaaacggactaaaatacttagtcggatgaacgagaaagttcaagctgaaccagctaggtgagctggacaagctaggatgaactagctagctaagctaggtgagcttaaccaggtggaagactagctagctcagctagatgagctgaccgacagctcgactgagctcggtgagctgatcgtgtactgacccagctgggtggtctggtcagctgacactcgagctggtggactgtggtagctcacgggtgaaaaggtgtctcggccaaaaggtgtaaggtcgagcgggtaccaacgaacggttgtgaccttttggaaggaacggatgtgaccttttggaagggtgcaaggaacggatgtgacctttcggaggggtgcaaggaacggatgtgatgcttcgggaagcatccattcgccccctatataagggaggacgcccaaggcctttgaaataatctcacatcatctcacaacatccaaaacaccataaaacattcttaaaggagtcccaacacatcgtagagttgttggtcggaaagggggtgcggctcggcgagtataattcgaccgaactgatgcgcatgctacctcccggtccaacggttcgatggagtgtagatgatggagagggtagaccgttcgtcttagagacaaatcggatctggtagaccgatcgttggatcggatcggccagaccgatcgtcagacggatcggatcggccagacggatcggatcggccagacggatcggatcggccagacggatcggactgactgatcgtcggacgggtcagatgggacaggccgatcgtctgacagaacgggacggacagaccgatcatcggatgggatggatcgagaaaagtgttcgaggaagcacaaggataagtgcatccgagcacacccaagggtcgcccatggatgcaatcttaccggtaaagggagaaagcaccaagaatgggtaaggaacgtgattcaccatataggatcaacatcgcggccgccttcatgtatctatctcctcagccatggtgaaaccgatcagagatcggtaagaccaaagggtgactcgacggataaccaacgggaaagtctacggtgggaaccgatggacaaaacggatgttggacccgcgagcaaacctaaggccgacggaagaaagatttcatgggctagcctacgatgatccagtggatgaatccacggacccttgggtgtgataaggatatagttcgaatcgtatggatggatcaataagccgaaagctttatcgaccaccataaaccggacggataaacggttagtaaaccgtgggcggtcgtagtaaatgaccggatcggaaacatggatggttcgataagccaagggctcaatcgtccaccatggaaccgaaggggagtacgtttggaggacggatggaccaataagccaagagcttgattcgaccatcgtgaaccaagggaatcgtacaatccccaatctctatcgttgtacttagaccagtggggttggttggttgtatggctaagtaacgatagggattggttcatcaattcacgaccgatgacgagtcgttgaacgaatagagtaaggcgacaaacgggctaaggaatcaaatacgcatattggccaaggtatgtaaagatctagcttattagttaagatagacgtttggtaattgaccgtgaaagtaggataaaggaatatgcgattgtttggcttagaatggttagcgaacatatgcatgtcttgaccgagtaaaggatagatctaagtctaagggacaaagacgatgaaaccggtacaagagttggttagaattaaaccaaggttagaaagacttccgctgtgtaataagagagcgattatagaatttagcctcgtaaaggcaattctatgttgaatcgcaaaaaattaagaggttcggccggagagaggcgcgaacttgagtactacgtcgccggacgacgagacgtccgggacggggtcttacaaatggttcattccctctagctaaaaaaccaccatcgagatatccgcaacttctggtctgtccggattggcaaccacctttgaaatagcaccatggctctcaagcttcgggttagacagttcggttagacgccaaaagctgagtgcgacaataaaatttcccttacccaaactctgaaagtaaccatccaagtactccgcctgttgattgcgggcttcgcactccaagacttcattgctacgttagaaatatggacagttagcgtttagagtgacattgtaaataaaacaaatgaaaagaacacttactatctatcttttatcttgaaactcagtttgagaccgtaatagtctgtagtcaatgcgccaacatcaaccaacgctccaacgacatctagatgatggagaaacaaagataataaacaaaaattttcaaaaatgtaataaatgaagcatcggagttattcttcctcaccgactaaaacgttcttgtaagcagatttctccaaaatgtagtcgaagggagtgaaatcgaaatctggaactggtggtgatctcggtggggcctgaacgacgacggtccgatccataaacagtatgtcgtattcatgctttgttgctctgactgagtcagttgacttacggaccaagaaagaggtgatcgtcttccactcattttcaacgaatcggtcttcgtaaaacggagcaaggcgacgatcaacggtggcctcaatacggttattctttacatacagaacatgatagtagacagtttaatatacaagttaagcgaatgaacgagaaaaacacataatgatttgacggaaattaccgcgtaatctgccaggataaggccgagttcgaagacgttgggcgatataaccttcttgaagactctcaagtcaaagacataaattcgccacccagtgatcagaggacacaattctgagaccatatgaaacccctccatctcacggatagcaagaacaagcgaatcgaaagactaaatttttatttgtgaatgatataactgccggcacaagaaatgggtttaaaatgaggattgtggataaaattaaggaagggaggagacttaaatagaggaaatctggaacggctacagttattaatgcggttccaactacacttgattcaaatttttggtaatagcttggtaaccgtcatatagggtaattattacgttgatttgacaataaacatcaacagttacgtcctttccattaaataccaacacaaccacagtatacccaaccatgtctccaactccgttcatttaagagggggaataagttagattttcaaaaaacttatttgaaattactcaaaatattgagcaaccacctctatgtacccttattacatgaactttaacacgtacacagacaaaaacgtacatagttatacaaacgtagagtttaaacgtacgtacacaacgtacatagttacaggtggattatatataaacttacgtacaccgagaaaacacagaagcgtacactatattggcaggctcagaaacttgtcaccagaactagattggatttttgcacatcttcttgttatgacctgcttgtcgacagcgtgagcactgatttggtaaaagtcttttctgtctctttttctgaagtgacaaagacaggaagttaaaaatctccgcatggtaatactcaaaatacaagtagatgaatgaacgatgttagtacatacccggttttcacctctagatgggatccttttggacagtggtcttcctggtggccgtctactgtatagaggaatgagtatcaaatccactatatgttgtgggatgacaacatctttcggatccgcgataggtagaattggttcttggaaagaatcagaaaacgtttgaaggccataccaccatccgacacaagacttcggatcaattccatgcttgattgcagctgctagagcgtgttcacaagggattcttagcttggtgtacctaagacacgtacacgtacactggtccagaacgacatgaaaatgctcaccggatttacttgtcacttgatagctccacggtccagacatcttcacagcgtatttacctgacgcaggcaactcttgtagaaatctctcatcaacctcaggtgtcacagaagatttgcacctagcaactttcttcctcctcgatgcgaaccatcgcattaggacatcccgaatgaactcgatcatgtaaataatcggataagtttttgcttttgttaacacatgattcatggactcagagctattgctagacatgatattgtagcgttctcctctacagtgagctcttgtccaatgcttaaatcctatgtcctctaggtattttgcgcatttagcactcttttcccttaacagttcaaaatatttctcgaaatccctgaccctataagctttggcagcgctgaaaaataaagcagacacaccaaacttaccataataggtggagaggtttcgctcaaggtgaacaacacatgctccatgatgcgctctcgggtaaacaacacttaggcctttgtatatagatgaatgtctgtccgagacaatcattaaatcgtcactgtctggaacaatctcagctaacttttcaaaaaaccatgcccaagaagcatcggtctcaccatcaacaacaccaaaagctattgggaatatttggaagttcccatcttgggcacatgcaataaggagacatcctttgtaaggttcgactagctgcgttccatctactacaactaccttcctcatatatatcagacctttgatagaagccccaagagagacaaagacatacttgaagcgctgcttaccatcatcttctggtgtatagtgtaggtgtgttattgtacccggattagctaattggagaagatacagataggtcggcaaaaacctgtaatttgctatctcatccccccttacattttccactgcaacctcttttgctctccaagcggtagaatatgaaatccgcacattcagatcatttaggagcagctgtggtaaatcgacagctcgcggcccaccctacgtagaactgtatctgctcctcacaacttccccgaggagcttataattagcatgtttaatgtagttcttccgagagtcgatgttacacgtatgtgtcgtagcatacgaagtgattttgaaactttctgaatccttcacgatgcaagcagtcaattgccatggacaagtctcatcaacgcacaccatctttaatgttttaggacatgacttaggttgcttgaagcaaaagcattgctttatcgcttgaagagacattgtttgttgcaggacttttctattcttaaaaacacttccaacaaacaaagtttcgcctgtggtgctgatttcaacctgtgtctcatcagctcgaaaattgagtaagtcatcgaacacaggagcagcatcgttaccgagattcgccaactcgccaccatgtaacttaggaaattcattatacacttggtaagcctcagctgcggtaactaccccattatcattctgtgtcccagttgaggaagctccaataccgtcgatcacttcatccccggtaacttcgtctatacaaataagattggaatccttttgcccttcgcagcgtgtaccgtaacccaatggaaaaattgtttcttcgccaggtacactaagatcagtgtacgtacacgtttccaagagacgactgaattctcttgtatctccgtcaggtacactaacacccgtgtacgtacacgtttccaataaacgactgaattcccctggatgttgagcagtctgttgagtgagattgacgtcttcctcaagatttccttatacatattcttctactattacatcgttccacttgttgtaatcgtatttttcgccaataccttcactaccgtctgtggtaggatacatggtacttcccccaatagatccatccacaccaagataatcatcacacccatcatcatcttcgttgccctcctccacttcatcctcttctgttgtatcgtcttcaacatcggcttgctcctctgcatcctcattattttcatcaacatttgtagcactatcaaacacacggtcactttcagaaacttcaccatgagacctagagacagtattcccgaacgccttcactgtattattgaaagagacgaacaagttgagagaaagatacccaccacaaacaaaaaaaaacgtttcgagacccatctgactgtcaatgtatacaggagggcgtttagtatctatcagcactgacatttctcccggcatccagtagctaattatgggattgatctcggtggacttcaaactgaaagcctctcggagtgtacggacaaagtccgtgtacgtcatggtttcctgaacgcgtacacaacgaccaaagatgccttcctcaggttcaaatttccattctccttctttgcatttccactcaccgaccatagtaaatacgggaatatccataacccacctgcatcataaattcaggagacacacattaaatgcaactgaaaaatactatacatataaaaaacaaatggaatgtcgatactacacatttataaacctaaataccaattatcatttgactattttaaacaaacaaatatagattttgcaaattttctgataaaaaaatggagttaaaacacaatcaagatcctaatatgacataacaaaaaacttcttaaaagaacttcattacttacacgagcaatgcttgttttggctccaaacttggtacaaaaacaagatcaacacttcttcaacagcaatgtacgttcttaattttttattaattattatcaataatttttttaatattatttgatgtaatgatgattttgcattaattgtgacaatagtcacatctaaacttttttggggcattaaatgttgatgtcacttcggaataatgaaaataatctcacttgtaacggaaccgaatcgcgtcaacgtgaaacaaaaaatcttcaactgaatcggaacagtgtacgtaactaaacctgctaaactaaaccgtacatttcaacagttactaagagagaagcgcaagggcagaaacgtcattttgcaggcgaaaagacaaatggtgaaaaccacatttgactttaacaatccatggaaataaaacatggtcaacgggtgtggcctgcaatttacccttatataaacactaatatatatatctaggctagtacagtttttcctctacgacatttacaaatctttttttttctttttcttaaaactctcattaaaaaaacaatgataaatcaaacatgcttcgttccggcttaattactgctcttccccatctcaagcgcattcccatactcccatcctctacaaaccttgaccaataccagtgtgacctccacacttgacccatctcctcaatcggaatacctttcgtctccggcaagaatctttaatgggtcggatttgtagatttacggtttaatgggtcggatctagatagttttaatcaatctttttataacattaccgttggataatataagtaagaatatactgtagcatagatactgatgattttatgtgaggctttcattgacttaagagccacgtaacccaataaaaatgggtcaagcccaaatgcggttcatttgatatgtgaatgaatgatattaaaaccaaattctatcgtgaactatctttacaaaacaatcactttctctctcgctctctctgtttcttgactctcttcttcattagtctccattgatcttgaaacaccattgatagagtcatgaagtttgtggtcgagattctgggtggttcatcgttcgagattgaagtggaacgcacagatacattgttagtggtcaaacagaagatcgagaagtctcaacgtgtcccagtttcgaaacaaacccttatcgtcgacggcatttttattcttcgagaagatcttaacctcgaccaatgccagatcttccacgattctcaaatccaactcgaagtctctcctgacgtgaaccctattcacaacaacgacgatcaaatcccgcaaacagagcaatctcctccagcaccgtggatttcagttgaagagtactttgcggagcaagattggcctttgacagaggaagagatcagaaagatttacagttatcggcctgagacaacccaagacatcagtaagattcaagatgcgcatcaaacagaggaatctccaccgtcaaactcagtcaaagagaccgttaacattcaagattcgtctgtgaagtttgcgagtaagaacaacaacgatcaagtgcctccaacgaagcaatttccacagtcaaacttagtcaaaaagatcactaacggaaaaaaaagagtccggcagatgctagtatatgtgtcgccatatcctggtatgaatgaagtcccaacgaatattctggtgcaagtgaaagttacggatgaggtgaaaacactgagaggtcttatgaaactggctcaagaagggtacatctttacgcacaataatcaagtattgaacgaagatcagtcatacgagtgtaacagtgttaaacccttggatacaattgtgattgttcccagacgtgttatccaagagaccagtaagattcaagattcgtctgtgacggttcaagtgcctcaaatggagcaatctccagcgtcaaactcagtcaaagagatcactgacccgaagaagaagattaaagtatatgtggtggcagcttcaagtgagtgtaaaggtctgaagagatttattgaggtggatgtgaactcgacggatcaagtgaaaatactgagaaccgagttggttgaaagtggtcggaggggtcatataagaatgcctcacgaaggatatttctttgtggacagaaagaaagagagagtattgaacgaagatcagtcattcgagtggaaccgtgttcttccagccgaaacagtttatatggttagtggacgtgatacacattttgcctcgtcttttactcgtggctctaaagtcacaatgctttgtgctcaaaaagttctgtagaaagtctgtatatatgacacagaagaaaccaaaaactatgatacattcagcaacagaaagttatgtggatctttaactctttgctaataggttttaatctttcttcaagttttcttctggcccttaagtcacaatgctttgaaatttttgagtatatgtagatacatagaagaaacaaaactatgatacatttagtaacagaaatttatgtggattttatcctatttgtaggtgtaactcttttcttctaggttttaatatttttcttcaagtaaacttgttgttattgaattccctttagtcgaaagcagcgatcaagcttctcttataagttacaaaccctaatttcagcaaacacaacttggaaacactagcagcaacaactttgttattttaaaacattagcaaaagaaatctcattgcaacatcaaatggcaaaactggaaggtaaaaaaagcagaacttatcaaacaagactaccaatatgatgaactgatgatttttttttttttttttttggctcaacaacaaactttccattcacccatttatggatacacagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatgcagatctttgttaagactctcaccggaaagacaatcaccctcgaggtggaaagctccgacaccatcgacaacgttaaggccaagatccaggataaggagggcattcctccggatcagcagaggcttattttcgccggcaagcagctagaggatggccgtacgttggctgattacaatatccagaaggaatccaccctccacttggtcctcaggctccgtggtggtatgcagattttcgttaaaaccctaacgggaaagacgattactcttgaggtggagagttctgacaccatcgacaacgtcaaggccaagatccaagacaaagagggtattcctccggaccagcagaggctgatcttcgccggaaagcagttggaggatggcagaactcttgctgactacaatatccagaaggagtccacccttcatcttgttctcaggctccgtggtggtatgcagattttcgttaagacgttgactgggaaaactatcactttggaggtggagagttctgacaccattgataacgtgaaagccaagatccaagacaaagagggtattcctccggaccagcagagattgatcttcgccggaaaacaacttgaagatggcagaactttggccgactacaacattcagaaggagtccacactccacttggtcttgcgtctgcgtggaggtatgcagatcttcgtgaagactctcaccggaaagaccatcactttggaggtggagagttctgacaccattgataacgtgaaagccaagatccaggacaaagagggtatcccaccggaccagcagagattgatcttcgccggaaagcaacttgaagatggaagaactttggctgactacaacattcagaaggagtccacacttcacttggtcttgcgtctgcgtggaggtatgcagatcttcgtgaagactctcaccggaaagactatcactttggaggtagagagctctgacaccattgacaacgtgaaggccaagatccaggataaggaaggaatccctccggaccagcagaggttgatctttgccggaaaacaattggaggatggtcgtactttggcggattacaacatccagaaggagtcgacccttcacttggtgttgcgtctgcgtggaggtatgcagatcttcgtcaagactttgaccggaaagaccatcacccttgaagtggaaagctccgacaccattgacaacgtcaaggccaagatccaggacaaggaggtattcctccggaccagcagcgtctcatcttcgctggaaagcagcttgaggatggacgtactttggccgactacaacatccagaaggagtctactcttcacttggtcctgcgtcttcgtggtggtttctaaatctcgtctctgttatgcttaagaagttcaatgtttcgtttcatgtaaaactttggtggtttgtgttttggggccttgtataatccctgatgaataagtgttctactatgtttccgttcctgttatctctttctttctaatgacaagtcgaacttcttctttatcatcgcttcgtttttattatctgtgcttcttttgtttaatacgcctgcaaagtgactcgactctgtttagtgcagttctgcgaaacttgtaaatagtccaattgttggcctctagtaatagatgtagcgaaagtgttgagctgttgggttctaaggatggcttgaacatgttaatcttttaggttctgagtatgatgaacattcgttgttgctaagaaatgcctgtaatgtcccacaaatgtagaaaatggttcgtacctttgtccaagcattgatatgtctgatgagaggaaactgcaagatactgagcttggtttaacgaaggagaggcagtttcttccttccaaagcatttcatttgacaatgccttgatcatcttaagtagagtttctgttgtggaaagtttgaaactttgaagaaacgactctcaagtaaattgatgatcacaagtgaaagtgtatgttacataagtggatatttcaccctttttccatcaatcaaaacatcatatagtaatccattggtttatacaaacatcaaaatacatttacctctgaaatgaggaaaaaaatgcaaagagatttttgaaaatttccaacaaatggagagaaaaaaaaaaaacaaagaattaaatcaatcagtacatttataaaggttatgagacctatatgacacttattggtcaagtggcagccattccatttctagctctaattctccagactctacattctgaagcttgatctgaacctcctgtttcactttcccatcaacaatgttaatgatactgtcatctattaatgggttatcatgcgattttagccatttcccaatctgcatatccccaaacatttctggatccccaaaagccattgcagatgttatcaaaggttgtatatcaatatctgcttctcccattatgtcatcagcagaaaatgtatcataatcatacacttgctgcaaccacataagaaaccgtaagatatatatataagctttggcaatgactgaaatcgtcaatagaaaatgaatttgctcttaccaatttcacagggccatagctctcaggaacagacagcatgagttcttgattccataccgggttcaaattactattcataacagttgtctgaagtttctgaataaacaagacaattttactcaagattcacagcatcaacaagaagtaaagctaataaaaagatgcaaagcaaatcacttacttgcttccctagattcaacacaacatatggatcacttgacatcatgtctctgattgctaagttagttcccttcttaatagtcaccttcaacaatccaataaactctaccattccttcctgaaactgtcaaatttaccgatttcaaaacatgcaagaagaaaggtataagaaagaaaacgttaacttatgcaagtttgaagctttaccatcgtctgcgatgatgaatttgtgcgaaaactatccatgatctttctagaaagacttgatgtaagaaaagctgaactctttgttgagcctttcccggatgtaatccgcaagcttggtttcagaaactcttgcagttcatattttgccctaaataaagattttgagtaagtcactatacaaacaacagcaatagatttgtcctgtcacagagtattttgttttagaatctgacctaatgaatctcatacgctggtcatgattaacatcaggtccaggcttagagcacgtgtcaggtaaaaaagcttcataaattgaattagcagacgcatttcctccaatttcaatcatggaatcgacttcctcatctgaccattcatctagtgtcacagacaaaacctggagaaaccaaacaatgagtacacaacgaaagagatctaattttgtcttgagtaatgaagaaaagagacaacaaatggacaaccaatatgtaatagagcaaagaagatatatcacctttgaaatatgagtgccgaggctcctgtgcacaccgcaacattttaagcaaatgaatactccgatatttgctgatctgaaaacaagctactaactgattattcaatataagaacaaacacaaagatacataactaaagacacaagaacatgtagatgaagctcaaatcgcataatgcgaataagtaactttcggttatggtaaagaaatgtgagacattcaactctatgagattaacccctaaatgaatagagaacatacagaaccaaacatattgtattagcataagattagctatatactaaatgacatgttgtttatcagcaaaactaccaaaagataagaagaagaaaaagaggcttagaagcgatgacttacgcccatttaggatcagaagcgccacaatcagcgcagactcggttatcaggttgatttaaaagatctctgattctccttttacctgttaaacacacaatgtggattgagtcacaacataatcagaaaccttgtgacgccattataacatgaaaaagtcaagaaatttcgctaaatctatagaatcgaccacacacacacacaaaagaaagaatctgtcattacctgagccaggcttaccgagtccggctgcataattgctcattgctcttctttcaaaacccaacgatcatcaaacaaaatcctacattgagaacaacccatcacgcacaaattgttgtaaatgatcacaacataagaaagttccaatttttatcatggaaatcaaattaaatttgcgatcaaaacgtgaacattgttgaaaacaaaacaaatgggccaatcacgagaagaatctcttttcatatcaaaaattaaaaacctatgtgaatcatccttacgttgtcggattccgacaccggagaggaaaaaaaaaccgacaaaaaaattttaaaatttgacctttaacattcttagagattggatgatctaaatatgaaacaagaagatatacaaaaaattggaaatgagaggggatttggtgttcttacaatgttgcggaagggaggatagatagacgaaggaaagaggtgaatttacaagaaaattggcaaatgataatatctgcaaatgacaactacgtgctcacttttctttttatcttattatttttttctgcgttttttaaataaagaaattagagcaaattgttaatttaaaaaaatcccaaaaaaaaacactatttccaatccggcgttattgtttcataggttttttttaaaaaatttttttttattaaaatttggtttatgatgaaaatagaaaccaaattagtacaaaagtaaatatcattcggtcggtttaaattgctttttatttattagcaaaacatattattttagaaaatatgtattttttaacaaataatttggttgaaaagacattaacttttcctttagatactttaaatcagtatttttgttgactaaaatttttaaaataaattgtgttgatttatcagcagattgattatggagataactgataataagtaacacatagttaacctcgttaatgcgtttcatcaaaatattttatgacgagtctaaatcgggttgattaataaaagtttgtgactaaaatgaaaagtcaaccaaatttaatacttttcctatatattttatatgatattcttggcattgaattccttgtttttttttaatctaaattattattagttgaaattatatatatgaaaattgtcaaacactcatatgagtgacatattatcataaaaataatgatatgtgtcattctacattaattaaattaaaaaactagcaaactaattgaaaaaaaagtcaaaaaaaaattgttgtgttaaattctccattaatcttactcttaaataaatttttctgaaaacattcactaaataaaaaatcataataatgtaccaagcactactttcattctattctacttattttttttacttttttttttatcaatagtcattaatccataatggctaaaaatttacttgtgttgtaatttagacgtttgctacctaacctcatattaatttagttattttaattggatattttttgttattacgttttctgaatttgatttatcatattgaccttctttctgtatatttttgtgcgttctgataactttgtaacattgatatctctaactattaatatttttccttgataattaagttatgtatgtaaatgctttttttaaactcgtaaatattatataaatttagaattgttttagctaaaaatatcagaaaatctataaaaattaatgaatattttatcttcttctaataataatatttttgccatgtggattaactttaaaagaaaatcttccaaatcagcaatcaaagaacttatcaaacaactaaatcgccgtcacttagatttataaatcacccctttgattgctcagtgatatcgtccccgtcacgccctttttcttaaagaataatttaggaaaaagaaaacaatatctcgtcgttcttttcggctttctccgattgtttttaatatttctcctaactctctctcgatctccgtcaaaataatcactgtttctttgttttttctcacaataaccctgaaacatttgcccaaaagagggaaactaaactccaaaatatagcaaaactgattaaaaccaaatatagagacagaaatcgaaagaagatacaaaattaatggagaaaaaacaatctaagcactagaattgaacaaaggcatgagagactttcacaaagcatccctatagaacctgtaaataccaaaagcaccaataagtccggagaaacctcacaccgacgacaaaccaatagcaaaccgacagggaggaaagcaagaatccaacgcgaccaaaaaccaaatacaactaccaacacacctcaccaactaatcggagagagcaagaaacactaggatcaaggcaaaaccttaaaatcgactggagacaaaccacgtaagatcaacaattcttacacgcggacacaatttccttggtcttatgcagcaaaattctcttgtttaaagaataataatttttattttctttaattcggtagagcaagaacacaaattctttattttaccacatttgtaatttggtatgagcatttttcccactttagttatcaataatgctgaatgctgatactcaaatcactaaatatcaatagatttatgtaaacatttaagggataaagcgaaacatttcttatttattagacgagtaaaataagggattggaaaaatacttcaaatcccccatttttcaaatttttattttttcccttgtacgcgatcaaaataaacatcgagcaatgtggtagttacatgaaaattcgtttatttccgtaagaggaaagctgagtttggggattttcattcatctgagtttaattacgtttttatactttataattcgtaactaattcgtattttgattgttgggtataaaccaaaggtcccacatcggaagttaagaaaaagagtttctaatatataagtcaagtccaactccaactagtatgaggcattttgggaagtaacccaataacaaattcttgagggcttgaacatgtagacccaaagaggacaatatcatactaaaaaggagttggaatggactttagaaaggaaaataaagatgaaggaggaaatggcgagaaacagaacaagaagaagaagaatgatcctcaggttatgaataatatttgagtatatataagattcactaatatccacaaactatctctgattcttgtttttatttgttgttgtttaggtaagtttgtccggtctactatactttgtagacgggttatggtcaaactctgtggaggaacggatcataatattcacaaccaaccataaggagaaactcgatccggcatttctgagaccaggaaagatggatgttcacatactcatggattattgtacgcctgttgtcttcaagaaactcgatgctttgtacctagatattcgaagaacatgacatgtttgagcttattgagaagatgttacttgaggtgaaagcaactctagctgagatcacagagcagcttatggtaagcaagaatccggatgtattacgcttaagggtgttgttgagtttcttgacaccaaaaggttgactaaggagatatactgttgattctaaaatttaaagaagcagaagcatgaagcttcaaggatccgtggaagtggttatgcatttcttagtttgatttaataactttgcctcagacactaaatttggaagatgacacactcgacatgtatcaactcttttaacatcttgttggagttcaatttgttgttataaagcttgaaagatcttaacgttccttgttcttgccattttgggctcaaatttgcagaaagtttctcatcttcaactattttaacatatacgtttcaagatcactaagaaatgctgaagtagagatatcctttaaaagattcgaggaatatatatgatggtaacaaatatgttgaaattgcagaaggagataataaagacactgcagaaggacttcatgtgagaggtgaaacaaatcacattgaagaagacacgtaggaatcatgatttgatttcagagcaacagcttgatgtgaagggttctggttatattgttaaggatttaagagtttgcaaatgaacttaaaaccgacaagatttgtgacacaaaacttctctaattgagtaaaacccttaaaacaacaaattacattcaatgtcttcaactagttacagcatgtgacaaaaaactagaatttctaacttctattggaaaccttaatactaatccttacataaaaccctaatttcaatgttttcaatcgtagatctcagtacgacacaggggacaagtgttcttacgcttgagccactccaaaagacagccattgtggaagacatgagaacaagtcatgcgtgtgacgtccctaggtttcggaccggagactagactctcgagacatatggaacacggctctgtttccatcttcaaactcttgaattcctctgctttcattctccctagcagaaccatcctcaatgatttctcgtcgtttgacataactgagacggtccggtaagtaactgtagcggccatggtcaaggtaaagccgttgtgcccaaaacctaagtctattgcagccgttgagatctttggggctaagtcatcgcacaagtaactctcaaaggggtagccgactaatcgatcgtggagaagcgttcggatgtggtcgtgactagagctacggagattgatatcgatgagaaaaggtggtgaaacctgagtccggcggttttggcgaccggttgtttggttttcaataatgatctctacagatttggttttgaggcgtatgatgactgagtttggttctgatggagagagtttccttccgttggtgacgtgaacttccacttcaggacgagaactcatactcatgtttcgaaacgcaaagagaaaatcccaaaaaaaataaaatcagaagaggtttacacagcgaagaagaaaattgtgatgagagcaaattgagagagaagaggatttgtgaagctttagggttatatatacaagcgtgttcaacaacggtcaggttctagtttcctttttcctgccacgaagaaattttcttttttctttatgggcttttaatttgggctttaatcctgatgggctatgggatgagttgtatgatattgtttatggctaattcagaattatgtggtgtggttttgtttaaatatgattggttcaattccggttaacctttggttaactgttttgtctcttccctgttctgtggcgttagttactgtaatttcactgataatggaaaagagagagcgtcgtttgtttgcagtgatggctctggcttttacggaaacttccgtactcttttaacagacctgtgtatgttgtagcttatgatagagcaatgtaaaacaatttagggttttttttttttgtttttgttttttctgtgcacacaaggtgttcgacgaaatgactgtgagacagagtaagaaaagactctctcaacatgtgttttgcaatgttcgaagaagaaaatattattaggagaggtgattacactttctgcatatttgagcccaaaatgggaaaaataaaagatcaaaaaggcaaggagcatgatcattctcagtgtcggagatacggttatgaaggaagaaattaaaaaaatactatatgactagttctttagatgaaactgtgaaggataaaaggacacactatccctagttttgatgaagaagtgttgaattctaaagggcattgataagaaagaaagcgtaatccgtgtatttcttatctatcaatccaattacaaagaatcaaaaccctaaatcgataagcttggagttacagttctccaatcttatctcctaagaacagagcacataagccctaattctactcgcaacatcaatatgatcacgcaggatgattctctatgtttgctctctatctctatttatactctgaattcttctcatgcttctctttggctcttcacacgtgcctattcatctcactcacacatgtgctctcttatcaggcattcgacgttttagcatggcttaggatctccaaattttgcagggtctgaggaagagagtgcagattttggtgagtgaacaaaatataaatgttatgctaacctatcttatttatatacttaaaatacttaatttttgttttgatgttaagtgcatccatcacctgaagtggtcttctgccaacaactcctcctcccacaccacaaacaaggccaaaggactgaatcactatgataagggcagtttatcctgtgactttgattatttcattacctgttttgcatactgattactgaatttggaacagtatcttgagaaaaaggagtgaggatcctagtaagactgttcgtaagagaaagaagttgtcttcatcaaaactaggttttcggagacttgataaccagtcaaagaaggatcaacttttcaacgagcccttgtttactggtaaaactttccagtgactctttctttcagttttactttctgttgccctttgtttttaattgcctatctacatttatctgcaggcttctcaaatgttttactcagtgtctttaaaaaggattgtgtagcaaaatcatattttgctgctcctaaagaacctgcatctgtacctgtatcatctcctactcgagaagctgaaacagaaattaactcggcctctccagttacacaatctacagttcctgattctactaatcaagagagtacggttcagcgatcttcaggtcagcaaactgaacatttccaaggtgttgcacttaaattcgtgcatgaaaacattcatatctaaactgaacaagttcaccttctggaaccaatgacttcaccactcatcctgaaacggtggagacaagatcttatagaacaaaacattcaaattccactattccataggttttgcctggactaaacatcctcgagtacatgctatcaccacctccaagatcttcaccttttagaaccaatggcttcaccattcatcctgaaacatgggagacaggatcttacagaacacaaccttcaacttccaacaatacagaggtttgttctcacatttttcgcttgtgtttaccattcctggtgcttttgctaacattgatagcagatactttttggttgtgccatacaggaacttcattttcttgaggaaggtgtcaataccccggtaagatcaccggttactcaagattctgggggtttttcaggaagaacaaggtaccaagattccaaaaaccatgtagcgtttttaagagcctatcgtttctatactaaccatctaacattcattgaacattacagagccttggctcagcatcttaaagaacgttattctggatatctaagtttgaacaagatcttggaaggaaagacaagaaaaatagctgctcgaatgttctacgagacactggtgattgattctcaatagatttctattcgttttatctctctatgcattgcctctaattgagatttgaagatgtagttgctgctgatggagttgttgaatgatacaagaagtaatacgcgattttatctgatggaatttctgaatgattcaagaagtaattcaggatgcgacagttttgtgtgagtgtcggtttctagaagatttgagaagagcgtgtttagaggatgaaacaaaaaggaaaaaggacttaaagagatttggaagacttgatgaaagtggagtttgatgagaaaaaggaaaagagtaaaaaggaaatttactttttcttacagaaaaaggaaatcttctcctatggtgattaggcaatcgttttgactatataaagaggtgctaggacgtcttggagaggcaggagagctgaggcataaagacaaatcattgagagctttctaagggtgtgtgcgacatagtttcgcggttttatgcgacatagtttcgcaggtttggtgcttgtgtgatcaagcttgtttggtggtgtgtgaaagttgttccagaaacttggagaattgaagtctaggctcagaaggagtttagctcagggttaggttatcctgattaaatctagactcaggggagtttagttaagggtagagattatccttaaggtttcacgtttatagaagggagcggtaaatcaagaggggtgtgcttgttttacgcgtttgcgaattggttgtaatttgctttcttgttctagtgaaatcgaaatctggacgtggtcccggggagtaggaaaaaccgaacctcgttaacaaatttcttgtctctttactttctgcactttattgttacctcatccgcacttacaagtggtatcagagcaggttcttgatagagatttagtcttgtttcgagtagatcagggtgaggttccggagatcgttcagaagatcattcaggaagtaagacagagtttgaaatcaagattgatggagatattgaggttgccattcaagaagcggttttcatggaatgaacgaaatagagctcttcacgagtttaaggttgatggaaacaaagaagtattgtacaagtcatctaaaggcaagcgatgttttgagtgcaaaggttttagacatatgtgttctgaatgtgcgaatttgatgaaggaaaaggagaagaaattcatcatgagtgattctgaaattgattcagatgatggtgaagaattgaagaatttagttgcctttacgacctttgagtctagtattgcgtcagcatctgcatcagggccaacatcagcgtctgcaacagggtctacatcagcgtctgcaacaggacctgcaactggaagtgataatgatcaaagtgatgatgatgatttaagtattagtgatgaagagtttgctgagaattacaaagctttatatgagcattgtgttaaggtagttgaggagaattcagtattaactaaggagaagctcaagttagaggctaaagttgttaaaacactgaaatttgctgcagagaaagaagaagaagcgtcacaacttgaagaaactcaaaagaatttgaggatgcttaataatggcacaaagaagttgggtcatattttgagtattggcaagactgataagtgtggtcttggatttaaaggaaatccttcaaaatcagatccggtgtttgtttatggtggtaaaatcacgtctgcatcaggaactgtgaaggaaactgcaactgtggcagagattgcatctgatacgagaactgattcgagaactgatacagagactacatccggtacaagaaaagttcaaaaattgcagagtgaacctcgacgagtttttcgaccggtttgtcatcattgtggagttgttgggcatattaggccaagatgtttcagattgttgagggagaaaaatcgattgatgaatgcttatgatgtgagatttcatggtcctaaatgttatcattatggagttcaaggacatatcaagaggaattgtttcaggttcattcgagaatgcagtcatgagggtttaaggcgcaacaaagtatgggttaggaaagatgattttcatggaagtggtgttctaggctatcaacctcgtattgcgaagcggggagaattttataagtaattttgaccatgttgtgactcattcagggggagaatgatgatgtgtttggtgatgttgtgttggagttagaactgatgagttcacaacatagtcaaaaagggggagatttgaagatgtagttgctgctgatggagttgttgaatgatacaagaagtaatacgcgattttatctgatggaatttctgaatgattcaagaagtaattcaggatgcgacagttttgtgtgagtgtcggtttctagaagatttgagaagagcgtgtttagaggatgaaacaaaaaggaaaaaagacttaaagagatttggaagacttgatgaaagtggagtttgatgagaaaaaggaaaagagtaaaaagaaaatttactttttcttacagaaaaaggaaatcttctcctatggtgattaggcaatcgttttgactatataaagaggtgctaggacgtcttggagaggcaggagagctgaggcataaagacaaatcattgagagctttctaagggtgtgtgcgacatagtttcgcggttttatgcgacatagtttcgcaggtttggtgcttgtgtgatcaagcttgtttggtggtgtgtgaaggttgttccagagacttggagaattgaagtctaggctcagaaggagtttagctcagggttaggttatcctgattaaatctagactcagaggagtttagttaagggtagagattatccttaaggtttcacgtttatagaagggagcggtaaatcaagaggggtgtgcttgttttacgtgtttgcgaattggttgtaatttgctttcttgttctagtgaaatcgaaatctggacgtggtcccgaggagtaggaaaaatcgaacctcgttaacaaatttcttgtctctttactttccgcactttattgttacctcatccgcacttacaagattggctgtattctggattgcaggtattgaagtctacatgacttatcgatatgaaacagaaccaaccctacaggggtacaactctcaagttgatgcctgctcttttatcaaagactcaactgtgaagaagggagtcggatggagaatcatgacacttagcaaaatgatatttaattgtggactgagtttaaaatagaaaattaaaatttaatttttcatactatgattaattgttacactttaaaaccgatcaaaaactttacatgattctatatgtatagtagaaattagaatatccgtaatcatggcacaccaccacattcagcaagtcgtttagtctcgtggattgataaacacatccgtaatcagctctcggtacttaaagctaatggccaccacaaatacgataggggattccaactctggctcgctctgaggaacacaagctagatcaagaatcttttttttttttttttttttttcttttgtaaattttttaaaaagtcgcactagttgtaacaacgctatatctttcttttgaatttaatttaacattctattcaaaaaaaaaaattagaatatcaaaataattcgctgtagcatatggttaaatgcttgtatgatctgtttgatcttccaatattccgttatgttttattaaaactggcttccacaaactgtgataaaaaaaattatgaaaattaaaaatattatttaaggattaaaaataataaattcaaatttaattcttcgtatttgattaattgttacagtttaaacccgatcaaaatttttacatcaatctatatgtatattataaagtcgtagactatcaataattccgctgtagcacacatgctaaatgtccgatcatcatcaatttgatcttacaatattccgggtttaaaccatggcagtggaaatatatgttttagatcaaaaaatttacatcaatctatatgtatagtataaagtcataaaatatctataattccgctgtagcacacatgctaaatgtccaatcatcattaatttgatcttacaatattccaggttcaaactccggcagcggaaatatatttttaaagtataatacatttgtggtttttgtctatttcattaaaactggcttccacaaacagtgataaaaaaaattgtgaaaattaaaaatattatttaaggtttaaaaatagtaaattcaaatttaatttgtcatatttgattaattgttacagtttaaacccgatcaaaattttttcattaatctatatgtttagtataaagtcatagactaacgataattctgctgtagcacacaggcaaaatgtccgatcatcattaatttgatcatacaatattccgggttcaaaccccggcagcgaaaatatatattttttaagtataatacatttttggtttttgtctattttattaaaactggcttccacaaacattgataaaaaaaattgtgaaaattaaaaatattatttaagattttaaaatagtaaattcaaatttaattcttcatatttgattaattgttacagtttaaaacagatcaaaatttttacatcatagtataaagtcatagactatcaataattctgttatagcacacaagctaaattctctaatcttcatcaatttaatcttgcaatattcggggttcaaaccgatgtatatttttttgagtataaagtcttgaaaatatattttttaaatataatatatttttggtttttatctattttattgaaactgactaccacaaaaactcgagagcgcgtcacatatgccattgtggggagaaaacgaatctggcgtgccattttataatctgagtgccactataaatgtgatattccgaaattacccttaatgaaattataactggtacaaatgagagattatagaataactagtacaaatgatataagtaaaagagaatataatgcaattggtataaatgtaataactatatataaatagaaacaatcggtataaatggtattattgaaaaataatagtacaactgatacaaatagtataagtgagatataaatatggacaactggtacaaaatgtattaatagtataattgatacaactcagttatacgggacaaatggtacaaaatagtggaagtttaagcgatttgtatttctaaaccctaaagctattatatttaatggcatcgtcgtcgccgccgattttgtgaaccgtatctccaagcgtcgtcgccgccgattctgtgaaccgtcttctccaagcgtcgtcgccgccgattctgtgaaccgtcttctctttttcttcggttatgcataaactgattttgcagagatttagtttggagatatctagggttcgttgagaagaaagaagagatctaagggtttgttagattgcagagaaagaagaagagatcgaagaaagagaatagaaatccatgaaaaagaagaagatagatagatagattcatggagaagaagaagaaagatttctggaaaattgattttgagagagaagagacaaaatctaaaagaataaaaagaagcgtgaaaaagaaaaaaaagaggcagtgttttattttaagttcacaaataaaggagtggcagagatacgtaatatatgaattaggttaagagtttttggacttttcatataaatttgatttaaaataaaactaaaattaaaatgaaaaacgtgggagggtatgagtgaacaattttattgagttagtggcattagtgataaaattcccaaaagagaaactctgacaagaaaagattatgaaaattaaagataaaattcccaatattccactaaaggtttaccaaaaaaatatctctttccctaagaggaaagcacgaacttactctctaagcttcccttttgtagaatagtaactcgaaaacttgctccccaatttttctcttctctttaagacacccactcacgtgcttaagcatcatcttcatttcaccacctgaaaactaacagcaatggcgtcaaatctcttcacaaaaatcccttcactctctgcaattttctcggtttacacatctctatctgccttcacgatcctcttcaaaaccattctctatgagttcattcccgtcaatatccgtgactttatcatctccaaattcacagactacttttctttttatctcaactccaatttcacgttcatcatcgaggaacagagcgattacgttatgaatcagactttccgtgcagcccaagtttacttgccgactcttctctccagaatcaccaccagaagtctcctcgtcagttcgagcgacctcaagaatccgatggctaaaccgaaattcggaatcccagtcaaagccaaaatcatcgatgaattcgaagggattcgtcttgaatggacacttctctctgcaaaagataatgataatccttaccagagtaaacaaaaacgataactttcctctggatgtaaccctaataaacggtaaaaccctaaaatttgtcaacaaaaagggtacttgtcaacataaaaccctaaaatttgggatcttttcactcactctactaaacagagttctaaccccaaaatttgatttttttttttcttttcttgtgatcactcttctaaactgagtctacttacgtttatttgtcatcaattcgtatttttgacgttctattctcaatatagaaccctaaattttggggggttttgttcacctaagtctagttacgtgttctaatgtctatgctgtgttttgtttatgttctgagttctgacactattttgtaattcccatttttcaatgttaattttggctttcaggtactttcatttgacgtgtaagaaggagtttagggacaagattatgtcagattacttcacatacattgcaaaatcatcggtgaagatattgacacataaagaaaatctcaatatctacaattacaatccagactgtctgagatgggaatcagcaatcttccaacaccacaccacatttgaaaccttagcaatggagcctgagctcaagaacacattgatccgtgacctagacgctttctccaatggaaaagacttcttcaaaaccgtgggacgagcttggaaacgcggttatcttctttacggtccacctggaaccggaaaatcatcgcttgttgctgcaattgctaattttatgaactatagtatctatgatcttcagattcagagcgttaaagatgatgcaatgcttagacagattcttacctcaaccgagaaccgctccattcttctcattgaagatcttgattgcagtggagcagatactacttgtagaaaggaaaataaagatgaaacagagtatggtgagaatcagaacaagaagaagaagaaggatcctaaggtttatgagtttgtatatatatataagcttcactaatttgcataaaacatctctgattttggtgttctgattcttgttatttgttgtttaggtaactctgtctgggctactaaactttgtagacgggttatggtcaagctgtgtagaagagaggatcatcatattcacaacgaaccataaggagaaactcgatccggcattgctgagaccaggaaggatggatgttcacatcctcatggattattgcacgcctattgttttcaagaaacttgctgcattgtatcttgaaatcgaagaacacgagttgtttgaccctattgagaagatgttccttgaggtgaaagcaactccagctgagatcacagagaagcttatggtaagcaaggatccggatgttacgcttaagggtcttgttgagtttcttgaatccaagaagatgaccaaggagagtgttgattctgaaatttaagaagcagaggcatgaagcttcaaggatccatggaagtagtttaccactaattacgcagtaaataacatgtagctctttgtctcattttcatttgggatttagaatgacagatagatccatcatatacatggaagtaatctagtacttatgtggtaacttaatagtaagtaactcttgcctctttgtctctgtaactctgttccatatttgggatattctcgtttagtaattaagtaactcttgcctctttgtctctgtaactctgtttcatatttgggatatttctcgtttagtaattaacagaaagagagaacaattcacaatccgtgaaataaagaaagtaactaaaaaggagcttgatgtgggaaaggaagatgaggatgataaactagtcaatgaactggaagagctgacaaacacagcggacaaagaagcttcttgcgatacgacgtgctaaggataagacgcggaaggcaactggtccacagataggtgcacttcaagatggttatgtagaccatgaattgttctctgatgatgacgttcatacgaagaccaattgttatttcagactctgatgatgacgttcatacgaaggccgagatattggcctgtgccaagaaaatgctaaggaagaagcagagagaagagatgcttgatggtgatgcttataacaaatacatgtttgcggcacagacagccgatgaaaccttattttgtttcttgataatagttgaaattagaggaaagattcatgtctaatgattgactttcttggttgagttacactgtgtccattaattgacacgattattcagttgcaaaaatggcgaaaaccacagaaagactattaactcaatacacttcaacatgccactgcttgttcttcctgagctgagtaagtttctgctcccagctttcgcctcgctcttcagcgactctcttaagcgtatcttgaatcccgggcatcattcctttaagtccgcaaaagtaaatatgagctccattgtccagaagtttgaagatttcatcgctgtattcttcaatcttgtcctgcacatacattttccctcctttcttgtttttctcttctctgctcagcgctttgtcgtacctgaaattttctggatagtccttgcggtacccggcaaattcttcatcatagagaagactgtctgagttagccacaccaaggaagagccaagcaagtccgtcaaacttgaaattgggaacattctccataaacatacgccgtaggtatcctctgtacggagcaactccggttccagtagcaatcattatgtgagtagctttcgggtcatcttcaggtaaaagcattacctttccagatggacctgtcaacaatatcgaacattttagaccatacaaattcaacaaaaagaagaggttctatatcagcaaaacacataaacttaccggtgattttaactttatcgccgggtttggcattgcacaagaagttactgcatacaccagctttggaaggatcttcttttcctgtctccggatcatagtaaatagctcgacggacacatagactagctgttttgccatcaaaagaatctccataccgtgttgatgcaatcgaataaaggcgaacgttatgaggtgcaccaggtttcttgggattctcaccctacgagtcaagaatagagcacatataatcagatatgttaccaaatctgagagaccaaatcatttatcagcaaaaggcaatgcgttatgagcaatagagttaaaatcacttacaggaggaatgactccatagctttgtccttcccagtaaggaacattaccatcatgatcaataacaatgtggcaagtctctccaggtgcttgtggaccaacaattctctcaaccgaaacaatagttgcagtataaggctccttaggcctaaacaagtttaagggagtctctttgggatcttcaagttctagaggagtaaccaagactttggatttgcttgattgctgaagtgacatgcatattgtggacctttttttcacacctaagcttctagatttcgaatctagtctcagcagaggaggaccccatgacttatcagtgaagcttatactttgaacctgaggtacaaaataattgagattcaatatcattgctcaagagttgcaaaatccagttttttgtaatcttctacttgtaaagactatacctttcaataccaaattcacaacaagtctacatcagaactaaacaacacaataagaaaaccaaaagacaaaaactttgaggaccatgtaatcatctcaacgacaaagatcggtaatctagtgatctagatcgtttttgctcaccttaatcatagatcggctcgacccatcaattctagttggaagtgcaacggacatctaaaatcaaaaaccaaactttcattaaatccgaaacttaatctcaggaaccaaaaaggtttagaatggtaaaaatgaaaacctgagaaggagtagttgagagagccatagcaatggagaaaagagacgataattctccagatgaatattaataattgatctcacaatcgagaggaaaaaaatgatttgaggaacaaaagaaacagaggatgattctgggtttatagtaagaaggtgaggggaagaagaagatcctttcaaggcccagaagagacaacaacagagcagcccatactgactgcaaatttctcaacttttttttggctctcgagagatcttagtggacaaattgctttttgtctgtgttggatcttctttacttttcaccacgttctttgtattttacttgtatttggtacttggaggttacagtttccaaagccaaattcgttgttaatagtgagaaatttaacaagttgcatgagactgaattcagcaaatttcttctcagttctggaaaagtaaaatcgaatttgttttcagaaagaagcttcggttatgtggtggtaagccgaaacaataaccaaaaattaaatcgaattgaaccaaatcaattcaaaattaacgtcggttctcattcggtatacaaagaaatggaaaaccgaaccaagaaaccaaattggagttttctaaaagacaagaaaaccctcggtttaagctgaatttacagttttgtgacatcgtgatttatttaacttgatgtaaaacgacgtcgttagttcagtgttcttcttccacagtcgagagtcgaaaaccctaatctctgtactcaagcaacattttcagacgaaagcaatcagaaactcaggtgaatcagaagcatgattcgagttacgaaaccaaaagcgatcatcgaatcactgagttaccatcttatccaaagatgctccgcaagtggaactcctaaaggaaaagcaaagctgaagacaggtcagccattgaagcgtaacaaactctccatcaagaaaggtggtggcggcggcggagcacctgttgaaggagaggaagcagttaaaggaaaaggtagaatttccgatgagaagcagaaactctacgagcaatgcttaaacgctccttgtcctgttcgctacttgaccccccaagagatcgagcgtgaggcgcaacgtgagaagctaggtttgattagtaaagagaagcaacgagatatggagatccagaagaaaggaggagctgcttcaatgggagtcaccgatgagccgatgcgaattgggacgccaggtttggattacatttcgttagggatttttgaagctgaggaattgcctaagtataagcttacggaagaagatggagagagacttgcgaaggagtatagtaaagtgttgatgagagagcatagagagcgtcgtgcagctgaaactgcgcttttgaatttgaagaaatctgctattgaggcattgccggagaatctgaagaaggcggcgttagagcctgatttgacaccgtttccggcgaatcgaggtatggctactcttacaccgcctattgaagggtatcttgagaaggttatggatgcagctaagaagagttcaagtaaagagaagttgagatgatttcgtttaaaaggttagagattttgtcttatctcttgcttttgctttggagatgagctttgaatgcttgtgtttcgaacaatggaatgattcaggatttaagaatgatggttagtagtttactgagtcttgggtttactttgttgtagaaagtgtctgaaataaagagaagttgagatgagtcaataaaggttagagatttttgtcttatgcttatcgttttctcttgtttctgatttggatatgagatttaacagtttgtttttcgaacaatggaatgattcagggtttaggattgatggttggtagtattgatctctgatgtcaaagctgtgttcttgggtttactttgttgtagaaaatatctcaaaactgatggttagctagatttcaggtagtatgatacttattggttagtttgagatcgagttatatgcatattagcaaataagtgaatgagaatcactcacttgtacatgagttagtgtttgcaatgttaaaatggaaacttttggaagcatgaccttcctctggaacttctctgcatataggctcgagtctttggattattatgtatcattttcgttttttttgcaggatatgttcttgtttagttattctttcaatgctgtttgcatttttcttgtttcaagtcttcattttgtggtattctatgtatgttttggatatttggaactttcttatcaattctctgctggtttttcttatccagttgaagctattagtcagaatggagcagcaacgagaccaagagacatcaagaaattgtctctagggattctaagcttgacttaagagaattcattcaagtagtaggctcttgtcttttttgtttggaaaagcaatcttcttttcgccggataaattacgatcaagtctgtgttcactatggatcttggtttaataatttgccttttcatatacttatcttcaacatttgggaaaacgaaacaaaaagctttactgagagaatgaaaaaattgggaactgttatcctctttgattcttcagagcctcaaaatgataagttcttatctctcgtattaagaaaaaatggtacaaggaacaaacaaaaaagggagcaaaaacttcaagagctacaaggaaatgtaatccctatatgacttgcgattagatctttggctttttagcaactcaaaactatccataacaacgcttcatttatcccaatgaaatacttatgccagtcttaagggatgtattgcgacaccattttgcgcagattttaagcatccccatcttccaaatcgagtttcctgccatgtcgatttcacaaaacacgatcagttttgagattagcaatcacacagacaagaggacaaagatagaaaaaaagaagagggaagagaacataagagatgatcacatacctgtccaacaccggcaatcagaaatttacccgattttgcaaaagccaaagagttgacaaatccagtctgtaagatcaaacaaggcattgcaaggattattacttggtgaagtgaaatgcattaatcacagtcacaaacaacagattcatcagacaacactaaggaatataactagtgaacgaaaatttaccagtggaagctcgtacaaaggtcgaattgcattagtttcaacagcccacaaacgcacaaaaccattaccagctccagatgcagcaagatcactgcctctactagtagcaactgcattgacccaagaatttgctgaacagttattgttgactggttcatgatcaccgttttctgttaagcaaataaataagaattagatatttcagagcatcagtagctgcaacgaaacaaaagtgttttataactatatactgcaatgtcaagatccaactgcaacagagatgaaatggggaggatctaaattaggtttcacctaagattccattggtggtaatcccatcaggtatatcttgatgtgcattcttgaaaacgaacaccggtttcttttttaacatgccccaaagagcaacagttccattatccgaaccagacaggtactcattatcactgatgaaacagcagctctcaagagacgatgcaggagctcgatagatcatacgggtgctctcaggcacctataatcatataacaagacttacaaatacagaataataatagaaaccttatgatgatatcttccaacagtgtttacatggaggatagaactattaccttatgatacagcatggttctatctcttccaaccgtaagtgcacgctccttcctcagtgcatcaatggctagaatttcaccctggtgtccatgattttcagttataaatgctttatcttctacgttccacaccttcacagttctatcaaatgaaccagaatagagttctgaagttccgtatctgaaacatagacaagaaactgtgttccggtgacctggaaaggcctgtagacacataattgtaatacctgagcgcaagacttgatgaagaacaaataaaaaaaacactaaacaaaaaccaaatttattatcattacctggacatgctctcgggtacgaacatcccaaatatgaacatgacggtcaactcctccagtggccaaataacgaccatcagagctaacagctaaagcaagagattctctactgtgatttttgttacgaggctccctcaatttcatcccatgcgacttgagaatttcatcacttggccatatgtatttgtcagttttaccagaagatacatcccaatgcataatagtaccatcttttgaagctgaaaatcctctagaatcgtcatccgataaagctaccgacacaacagatcgtcggtgcttgacaataacactaaacccatcagtacttagtggctcctgaaccctgaatcattgaaaaactttaatcaatactactatcaaccaatcttcaaagatatcaaattgacctaagaaatgtacaaaatcactaagtttcttcacaattaaaccagctccctaaaacactaactacccacaaaccctaaattaccaacaatctcaaacctaaactatctaatttgaatacattgaggtactaaatttcttccttacctcgatgcaataagtcttcgaatcctaccactatcctcctgctgcttctgcatcaaactcttcttaatagtctcatcgtcatcttcatcatcatcatcatcattatccgcttcctcacgctctctcctcatcgcttccctccttctattcagcatctcctccgccaatctcttccgcttctctcccgccgtctcatcagcaaactcatcttcatcctccacttccccatcaactcttctcccatcttcatctccgccagtaaatccgttctcttccgcatcagagtccacagactcgatatcgtcgtcatcgtaactgacttttctccgtttcttcggctcttcctcaaaaaatggatccctttcattcgaaccctttttacctcctctcttaaagcttcctcctttcttcttctcgttgttgtacttcattcttctctctctcactccctcttagggtttaacgattttacactttgactcgtctaggtttagcctcagggtttagtggcgacggaagaagctggaaaacgattttgtttatttggtcggaaagtttacaactttaaaccttccactaggttttcttcaggaatcgggtctaccgggttgacccggactaaccaagcccatgacttacctggtctatggtttgagcccattaactatttcgttcttttaaagcagaaacttgggcctttaatttgtagagccgaagactaaccggaccgtcaatttaagtttggttcaatccgatttctgaatttttggttctgatttctgaagagtagtacgtaaaccgaattgggagattctcttatttcagtaacagtttaatacagtttttgtttagtgttttcaatttcggtattttttacaaactcgaatcggatgattccggtttaataaaatcaaatgagttcggtttagctgaatttaaaactgtttttaatcttatagtataccgaaccggaccatccatctaatttcaattgtctaccaaaaccgaccgaccagtctttgtcgaaagttgtctttcttcttccttgttcgattttcgcctcctttggcttttcattctctctctaacttctctatgttaaaattccgaaagctcgattcagaaatctagaagcttcctcgagggccctcgcgtagaaagtcgaactcaaattccctggagacaaagaagaggaagatgagctcatggaactacgttgttacggctcacaaaccgaccagtgtcactcactcgtgcgttggcaacttcacaagtcctcaagagctcaatctcattgtcgcgtacgaaactctccccctacctctatttgttatcaatttttgtttgtcaattagtccccttttgaattgcagctgttgatttgggtttagggttttcaatgaatttcccatcacgagttaattttcataaatttacccactttgcaaacaaaattgtagttcaatttcagtttgggagatgactataaggattttaatgcctctgggttctttgatgaggtggattttttgaaactgtgacaaagaattgtgttttttttggtatggcttttacttcctgaactaaattacatttgaagatcgtgccttttttgatatggaggattttcaattatcgttagctatcagtactgtaaatttgtttgaaagttatctcatttatccgatttagcattgtccccttaaattgtaacatctatcagatccattagtagattagtttgacagcagtgttgatctgttctcaggaaatgtactcgaatcgagatccatttgcttaccccacaaggacttcaggtacatacatctctattctgtcaagcttatatggattaagttccatgtacattagagtataaagttcaaaaactttgttgtcatgctttgttttgttagtaatataagaatctgctggatgttcctatattgcagcctatgttggacgttcctatatatggaagaatcgctactctggagttgttccgaccccatgtgagtatatatctcttattgtgttcttttgtcatggtcttaataatgagttaaaatgttgatagtattgtccaccgtcttttgtagggcgaagcgcaagactttttgttcattgcaactgagagatacaaattctgtgttcttcaatgggatcctgagtcctctgagcttattacaaggtatagcttccaaaagataaatttttttccatgcatccagttgatgttaaccaaccagttgtgctatttttcttttagttcatgatcatgttcgccgttatcttatcatttttttgttagaaataaatgtattacactcgtcacctatgtacagattagtgcatggtaccaacttgcctgttttagatagctgtttacagcatattcctgctttacaaaatctgatctataacctatttctgattaagcattttttatgagagtttgattataggttctcacctttcacaaaattgatacattgctgtatatccaaagcatggaaaaaatcatgtatggtgctggcgtaattgttgcatcttactggttattattggaagcaatatatcagatgaccattttctactttacagctgattctgtatgatgttttgacttttttcagagcaatgggggatgtttctgatcgtataggccggccaacagacaatggtcaggtattgaatatcgtcgtcttgactgtgcatttcagagtgcttatatatttactttccttcatcaaaaaatatgcgttgtcattaagggtttggtgggcatgtagcttacctctgatttgacaattgctttgtagattggtataattgatccagattgtagattaattggactccatctgtatgacggcttgttcaaggtataatgttaccttctataaaaactttgacagatgtgcttgtttacttaaatatatcatgttactgaacttccactaatctatctgtttatacatgtatgatgatgcgttctatttccttggtttttcttttaggttattccatttgataataagggacagctcaaggaagcttttaatatcaggtactctttaattctagtgtgcatttgtttccaggcatcagattctttcgtaaataaactgtttaatcctcaatatactcattcctctagaatcactacgatatgatttttctggggatatttaaaactgaatgatgatgtactgagtgtggtgtctaaatttcaggcttgaggaattgcaggttctggatatcaagtttctgtttggatgtgcaaagcccactattgcagtactatatcaggtattgcaaatatcttaacatgcctgtgctacgaagaattttgtacatgcatttaactttgttatctgggcatgcataagtctttccagagttcacattagaaagaactcttgtggagttgattaatatttgtacggttggtagttgatggattttaagctaagtatttgagagttagttatttaaacagttttttttttttaactttataatctatattgatgatgtagtctgttgtacgagatgcaatctagaggtttctccggtgggactaactaatcattggttgtgtaggacaacaaagatgctcgtcatgtcaaaacatatgaagtctctcttaaagataaggattttgtcgagggtccatggtctcagaacagtctcgacaatggtgctgacttgctgattcctgtaccaccaccgctctgtggtgtccttattattggtgaagaaacaattgtctattgcagtgctagtgcattcaaagcaataccaataagacctgtaagttctttcaacgtaatctcacctgcttttgtaaacaagttgcttgagagttgagatttctgcgggtactccttttttttgttttcttagtttgatatgcgaccttcatttttcgtatccagtccatcactaaagcatatggaagagttgatgttgatggctctagatatcttcttggtgaccatgctggaatgattcatctgcttgttataacgcacgagaaagaaaagtgagtgtgcatgtgtgcttactcttacatccatccatattcgaaataattaaaagctctttagaacttatttactttgtatttgtgtctgaagggtcactggcctaaaaattgagcttttgggtgaaacatctattgcatcgactatatcgtaccttgacaatgccgttgtctttgtcggctcaagctatggtgattcacaggtatgctagaagatggttatggtctctcactatactgtttttttcaatttggtatctgtagtatgtaaatcgatattgttccatattttctagttgagcccagtagttttagtaataattctctgtggagtgtggataagaatttgtttatttttatcgttcatagcataaattcaaaagataattttatttccttctctctggcttctaagaaaagttaaatcgaccatctgagtgtttccatgtttggttttctaattgcagctagtaaagctgaatctacaccctgatgcaaaaggctcatatgtagaagtcttggaaaggtatatcaacttggggcctattgtcgacttttgtgtagttgacctcgagagacaggggcaaggtcaggttgtaacttgttctggagcatttaaggatggttccctccgcgtagttcgcaatggaataggaatcaatgaacaggtttgatttatgcgcgaaatctcattgtcttgtatgcacaattttctcatatggtttctatatcttaaaactccgctctattacaggcgtctgtggaacttcaaggtatcaaaggaatgtggtcgttgaaatcttcaattgatgaagccttcgatacatttcttgttgttagctttatcagtgaaactcgcatattagccatgaatcttgaggatgaactggaagaaacagagattgagggcttcttgtctcaagtgcagacgttattttgccatgatgctgtgtacaatcaacttgtacaggtaagaatttctaatgctttggggttttcaaaagacaattaaatttgatagctgttatagcttagttgtctggtctatcctctctatttgtgaacatgaattaactgctgccttttctggatcaggttacctcaaattctgttagactagtcagttctacaactagagaattgcgggacgagtggcatgccccagctggattcactgttaatgttgcaactgcaaatgccagccaggtttgtatttcattctcgatttgatttagtagttttgtacctagctgctatctttatatttttcatggaagaggaatctaactttggagtgtctagacatacaacacgctttagaataaacatttgtagagtgactctttaatgtgcttgttaggttcttttggcgactggaggtgggcatttggtttatctagaaattggagatgggaaattgacggaagtgcaacatgcccttttggagtacgaggtttcctgtcttgatataaaccctatcggtgacaatcctaattacagtcagctagctgcggttgggatgtggacagatataagtgtgaggatcttttcgctgccagaattgactcttattacaaaagagcaacttggaggggaaataattccccgatctgttcttctttgtgcattcgaaggggtatgattccattggaccttgttacaacgaccatacattgattgagatgagctgagaaccgagttaaatttatggtcgaatttgacatacgttatgttgcagatatcttacttgctatgtgctcttggagatggccatcttttgaacttccagatggatacaactaccggacaattaaaagacaggaaaaaagtatcactcgggactcagcctataactctgcgtacattttcatcaaaaagcgccacacatgtctttgctgcatcagatagaccaaccgtgatctatagcagcaacaagaagctgttatatagcaatgtcaatcttaaagaagttagtcatatgtgccctttcaattctgctgcttttcccgacaggtacactaaacatcctctctttttcttgtcggtttttgctttgaatttctaattcctatatgaagctaagtggctctgaaatctgattctctgttctatcttatgagcagtttagcaattgccagggaaggtgaacttacgattggaaccattgatgatattcagaagcttcacatacgtactattcctcttggagagcatgctcgtcgaatttgccatcaggagcagacacgtacatttggtatctgcagtttgggaaaccagtcaaattccgaagaatctgaaatgcactttgtccgtcttttggacgaccagactttcgagtttatgtcaacttaccccttggattcctttgaatatggttgttcaattctgagctgctcattcaccgaagataaaaatgtctattactgcgttggaaccgcatatgttttaccggaggaaaatgaaccaactaaggtatctgttttctctgagaacatatcaacactctcagttcaaatattcttttctaatttgtctttgaaatacttatttttattttgtgatttagggaaggatattagtatttatagtcgaagatgggaggttgcagctaatcgccgagaaagaaaccaaaggagctgtttattctctcaatgcctttaatggaaaacttcttgctgctattaatcagaagattcagttgtacaagtggatgctgagggatgatggcactcgtgaactgcagtctgaatgcggacatcacggacacattctagctctctatgtgcagacccgtggagactttatagttgttggtgatctcatgaaatcaatctccttattgctatacaaggtataacttctagacgaaatttgtgtgtttaaaaactgatctactatgttcatttggtattgtttctgatggcttattcttgaatgtaaaagcacgaggaaggtgcaattgaggagcgggctcgggattacaatgcaaattggatgtcagcggttgagatactcgatgatgatatttacctcggtgctgagaacaatttcaatctgttaacagtgaaaaagaacagtgaaggtgctactgatgaagaacgaggacggttagaggtagttggagagtatcaccttggggaatttgtgaacagattccgccatggatctctagtaatgaggctacctgattcagagattggtcagatcccaactgtcatctttggtacagtcaatggagtgattggagtaatagcttcacttcctcaagaacaatatactttcttggagaagttgcagtcaagtttgagaaaagtgattaaaggagtcggcggattaagccacgagcaatggaggtcgtttaataacgagaaaagaaccgcggaagcgaggaatttcttggatggtgacttaatcgaatcgtttctggatctgagtagaaacaagatggaggatatatcgaaatccatgaatgttcaagtggaggagttgtgtaagagagttgaagaactcactaggcttcactgagtcaaatcaatcatcaatcaacgccaataggctttgttttattttatttctttttaagctttcttgagttaaaagtcttcttttgggttttgtgtcttgtaatattaatagcttgtgttggttaaactattgtcttctaaatcgaaccggcaagcaaaccggactgtcttctgggtcccttgacttgatccaaacctatatacatgtttttattttagttttttttctacatattatcaaatatggttttgttaaacgaaacttattatgttttaactgttctatttactcgttttgctgatgattctttgcttgtaaacgtctctttctcaacttttacgtatgtgttacaccaaaaaaatcaaaaaaacaaatcggttaatagattggaaagtaatattcctatattaaactttctttaaatagatctcatgcgattatgttctttaaggtaagacaagaaaaaaaagatagcatgaacattttacatctcttgaaggcacctttgattccttaagaaatctagattcttcttttctcatttaattatggtcattgtaacaagtaaacacacattacatctcttgctcaagcctctctatcaattggtcatcaaatttaaagatcggtgcaccgttttgtaaggcttgttcttatggttatgtgatggtctagattctttctcccatttaagtacaagttttctatattcaatcatcaaaaaatgagaacacaattttggatatttctactttttttgcttctactaaacttcttctctcaaggtaaatcatcgtattcttcttctctaactattgaaaaatataaataatcattctctctgttttttcaaattataatctttgttttgtttcgtttggttcgatatatattcaatgtgtagctgcaaggccagtgatgacgatcagaccagagtcactagtagggccacaagggaacacgacgttcttggagggaacaacatggtgcgtggctagaccaggtgcgacacaagctgagctacaaagagctcttgattgggcatgtgggattgggagggtagattgctcagtcattgagagacatggtgattgttacgaaccggacacgatcgtatcgcatgcatcttttgcgtttaatgcatattaccaaaccaatgggaacaatcgcattgcttgttacttcggtggaacagctacattcaccaagattaaccctagtaagtaaaaaggttaacttacatatgcaattatttctattcggatagtatttcgtaagagataatcgatttcttactcgaactattattgtattatactttgaaacatttttcctactaattacataatcaatttttaaagttattttattttatttttcatggtaatattaagtgtgaatttttgtgatgttgttgcttgcaggctacggaaaatgctcctatgatgcatccaagtaagagccctaaatttcatcctatattttttcactaatccttatagtagttcaaaacattttcgttcaaaaagtataattttatagtgattcttccttcattcagatcggaagtctccaccgcaagatctttatcagagtacaaagctcggtggttgctgctgatgtacataggagttttttctcttattagtcggcgagactaacatctttgcaccagaaaattagatatttgcatatcaattgtggtggaatctttttcatagagcaaaattttcaaactttttggctattgtagcagttaagctttgtttttgttcttacctttgttcatgggtttagaatctaaaagctttttgagccttccttacgtctgacaacaactatctctttcattttcatgttaaaatatatcttagtagtactttatcaatttcggtatagcaatgtgatcaaaacattcttacaaaaataattttatcattgacttattcgttgattgatttagccaaaatcgagacgcccgcatgcatggttttggtatctacagtgtagacatgtactttttagaatagtgtgtatatgtttagaaaaatacttgggttacccttgtattcaccccctttattctaaacctatcattatgttatgtcatattataattaaggaaatcaaaacctgtaaatttttaattaaatgtagtatttatactttataattaaacaaagttatatatatatttgggtttataaatataaattagggtttagattttacaattaaaaaaatctttatgacggtttgtgtttttaaaatagaattagggtttagatttcttttacaattaaacgagtttatatgacagtttgagtttataaaagagcggttagggtttagattttacaattaaatagaatttatatgacggtttgggttttgtaaaatagaattagggtttagatttcttttacaattaaacaactttatatgacggtttgagtttataaaagagaatctgggtttagatttttttttataattaaacaaaattaaatatcagtttaggttaaaaaaaagaggtaatgtttagatttgttattaaatgattgttttttatttataaacaaatgattagatttgattttataattaaatatatttttcttaattatgtggcacattctaattgggtaagaaaatagaaggtgaataaaagggttcaccactaggggtgaacccaagtatcgttcatatgtttatatataataaatagaaattcatatttcatttatagaaatatttgtcttagaacttaccacattattaaattttcttatggaagtttaaaatgacacaagtgatacaatttgatcagggctgttatatgcatgtgcaactggtgcatttgtactgggcccaacaaatttaatatccaaatttatagttttccattatttaactatttaattatgctaaaattttataaaatatctacatgtaaaggtcccaaaatctattttaaagggtaatattgaggtccaaatagctataaaatacaaaatagtttatgaaatataactttttttattcttttatctaatttcctattaaagataggattttttttgtatggcaccgggtcttgccgatgagtgagccgggcctgaatttgattagatataaaaattaatgtgtttgataccaatcttgtagtcttgatttggatatttttagttcgacataaaccaataacaaaatttgtttatgtgatgcaatctaatgaaatttagatgaattcatttgcaacaacattcaaaattttgaatctaagattaatgatctcaactatcacaaaatttccatcaatatacaaggatatcatgttaatttgtaaacaatatagctttttcatttacaattcttgtactaaagtaaacaatgctaccttactactcctcatacaatacgaatataggtgggttacatgtataatttaaatgttgtattcattaacacttttttattgttgatttttatgctcaatctatattcaagtatccagatatgaggatgaatatctctcgcatacaattatgcagctacaagtaacataagaggatgctcacctcttgctttatacgaaagaaaggacaaacctctttaaccatcgatctcaagaagctgcaacatgtatttaaaatggtttagatggaactatttgaattcttatcaaaatgtatctcttttctttttggtggggagtttgctttttgcgaaaacaacataagatttatctattatatatctacagttacttggatacagtcctgcttggaaaatcagtcaacgactatgcttgggaaaataaaaatgcaattatattagatgtatgttgtaatcaagattttgtttggttaattgaagatttagtaaatgacggatacaaaatattgttagtaattggcaaagagtgacaaaaactatttaccaatatgtctattctacatggaattgcattacatggccaaattttgcactagtggcactaatctgctattatattttattgaatattaattatccaagtcaagaatacaagattgatatcgaaaacaataattttattagaacagattgtatcacttgaattattctaaaatcccataataaaatgttatagtgtggtaggtttaaagtaccaacaaatttttttcttatcatgtagttagaaattaatttttgaacctttaaacacactcttcctagaattaaccgttaacaaaacttataatttaaatcctctgttctactatgacatgattcatagtaaaaattccattctttcttttattttaagttctcactataaatttatttatttatttccaaagctaaaatatcataatttgttacagcatcaaagacttattcactcacttgtagaaaaatctcactctcaataactaatgttccacgtagtataatatgggcttttgaggcctaatttacacggcccataaagaaagatttctctagcaaaaataaaaccctcacggccagagatcatcgtctccaagcaaaaaaaaaaacctaaaacctccatcaacgccggaggaagaaattttgtgtcatctacaacgaattcgttaatcgcgatgaaggaagacgaagtaaatcgatgccagattcagaattggtatccgagattcaaatccttaaccatcaaaaccaaatttcacaaacttccagaatcattcatcaactatctcatcgacgattctggtccgtttcttctccctcattccgtaacaaacgaagacgcaatgcctaacagagtccacaatttcgaagaagaagatgatttccaagtccccgaagaagcttcagatgacgaaccattgaatcgtccttcttttccagaactcgaaatcgagatcagagaatcaatcgaaaccctaggcggcacaattatcccgaagctgaattggagttcaccaaaagacgcagcttggattagtccatcacagaatctaagctgcacttgtttcaatgagattgctctcttgtttcgttcctctgattcgttaacccatgatctcttcaatgcttatgattcatgtagtgacaaagtctcttcaaggccagaaagtttctaccttgcgttgagaaaatggtacccttcgttgaagcctgagatggaatttagatgctttgtgaaatctaacgagcttgttgggatttgtcagcgtgaggtaactacattttaccctgttcttctcaatgagaaggatttgctcaagggtttgatagaagagttctttgatgataagattaggtttgaatttgaatcagagaattacacttttgatgtttatgtgacgaaagagagaagagttaagctaatagatttcaatacttggtgtggttctactttgccattgatgtatacatgggaagaacttgagaagattcatggagaatgtgatgaattggaattgaggattgttgagagccgtctcagtgtgcttcctggtttgaaaacagctgttccttatgattatcttgacgtgagtgctggtagtggttgggctcaggttcttaagatagtggaagaggagtttcagaaagacgatcagagttctgatgaagttgcttgaagacttagattcttggttattggaagactagacaataattttttgaactatcatagttgtgtgcctaccaataagtgtcgtgttccattgttgttctgaaacggtttaatcacgatgttggaactttgatggtgtctttttcttataagattttctcttctagactgcttttgtatttgtcttgttattcttctgcaaagaattgtgttgagtggcaaattgttcctgattggtttctcattaccaaatttgtacatggatgttggattagttgtttgggtcagaccggtacaatccggttcggtttaagacaatgtcgaaattcgaaatataacaaaccaaatgttttataagaaaaacagggaagagaaaacaaaaaaaggtttaagatcttcaaaacatgaagaacatatgagattctgaggttgtctttacacaaagccgtctcttttaaccttattcttcatcatcgaccatacgattacagtcgtcttagtttatgatcttcgtaaagtgaataacttttcatccctcgattattctctatgataaactgcgtttaattctttcaaaaaaaaaatcatttcttgcccaagtttggatctttttggcatcgttaatctcaattctcaagacaggtagattggtgagtaaaggtttctttttagctttggttaaattctgggtttgccttgttttcggtccacactcaaattaggttaaatttcaattctttcgaggtttcagctaggtgctttagcggcagtgaacgatgatcggtcataggatctcaagattggggtctactattgttaaacagctcgcaagaggtactatctggtatctgctttaaatcgatgctctttgatgcgtttgctatattggttttgatggagtttctaatctcacttcgatttcgaactgcgtatgcgtattttagtccctcattcatgggttttgctaaaacattgtctgcctacacaatgctgccttaatattttgctgctctttctatttcttgttttggcagagggatatttagcaacatacgggacaaagaatctacaccggtcttatggccactacttgcagtctttggttagtctgagcttgttctcgagttttatactctcttacaatcgataattttgttacttcttcatgtataaactctcattaatacttagaataggattctttgttagagttcactctattatctggctaggtagaatctcgttagtaatgtcataaagtgatcgcagaagaacgaaatgtagcttttctgcgcttgtttggtgttagatggatctgttagtgacgattctaatgtgtccagttggaaagagtcctatatttggttttggctcaaaggcctaagaaaaggcttaaggtgagaaattgggtggtctataatggatgaatgaacagaaaatcttggttttgtcactcatagattctgttttgtttccacattgatggttgaatctttctcgtttcatcttttcgatagccagtggtaccaaggcaagctaggacttctcaggaagcctggtttttgaagagccataagttttgtacttcttcaacaacttcctctgagaatggtgatgaagaaactgagaagtaagttactaccgaaatattcatccagcgctgaagcaatatttgctgatagtttatcataattctgttgttttcaggataaccataatctttgttgataaggacggagaggaaattcctgttaaagtaccaattggaatgtcagtgctcgaagctgctcatgaaaatgatatagaccttgaaggtgcacacttctcttccattttcttctcgttttcaattgcttactctcatagctttagatgggttctattaattatattgatcctttttcgaattgaaaattcatggattgcttttacttgatctccaggggcttgtgaggcttctctagcgtgttcaacgtgtcatgtgattgtgatggtaaacatattcttccattattaatagatcgaatcctctgcttttccggaaactagctaagattgtatttacaggatactgaatactataacaaacttgaagaaccaacagatgaagagaatgatatgcttgatcttgcttttgggctcacagaaacgtaaagtcctctcttactcttaaagcaaacacaaaacaagaagtctaattgtttactttaatgagaaagtatcatatgttcccggacaaatgtttcaggtcacgactcggatgccaagtcattgcaagaccagagctagatggtgtgcgcttggctattccttcagcaacaaggaatttcgcggttgacgggtttgttccaaaacctcattagtttccgcagagattcttcgacttgaggcattaatgatcaaagagctgattcatgtttctattggagttttgatgattgcttaccgagaggaaacagttcttagacctgaggcatgaaatgatcaaagagatgattatgtttctattggaggacttgatgattttttttattacttatcttagttttgatattggcatttctcgttgttgtctgagtttctaacagaacaacaagcgttaagcaaattttttggagaataaactcaatttctttcgtcaaaagcaagatgaaacaatcaccatctttgaaacttttctgagcttagaaattgttgaaagacaaacagcaaaagacatcattacaaacggtaacatacttcaaggacacataaaatccattgaaactatgagctaacttaaaacaagtcatgaacaagttcgaaaaaaattcacctgcacgaaaccgatgcatctagaaatcaaactggtcatagtcagaaaagtcactagcacctgagaagtcatagtaaccctcaaaatcatcatcacctgacatcagatcgatatcagagaagtcataagggtcttcgtcttctgatgaaccaatgtcgatatcatgaatcgagtcattagggtgtctcacaactttgacactctcaaaacaccgcttctgcaaatccccaacaaggttaacattgaaacaccggcgtaaatcaagatgttccaggtttgagcaattgtcaagaatagcgtttaaaccggtgtctgacaacccgttcccacaaagctggagatggcgaagtttcggcattgtttcagcgattgctagagcatcatcgtcattctccttttgaggatgcttgttcagcttcaaagtcttcatatttaaacaacactggcctacaactctgagagactctactgaaaatgagcagtatgacaactcgagttcttcaagtggaagtttcacaactgcttcgacaaatccatcgtctgtaatttgagaacaccttataagtctaaggcttctcagattactcgacctgcaaataattgtgtgtaacaaagttaaaaacaacatctaagatagagaagaagaatgacaaagatccaaaacatcttttttctagcatcccataaaaacctgaacctaactattcatacctcagaagcataacaatcttataatcaagtgactacttactactccaacatagaatttagatacaatgtaacacaacacaatcataagctacaaataatttccccaattctcacaagaaatagtaacttccacaaccaaaaactgttctaaccctagaacaaacatattgaaatcaaatcaatccaagttctctaaacaaggaatcaaaaactccttttgacggaaataaaaattggcgaaattttgagtgggaaaagagagaacctatgggcgatgtaattgaggagatcaacagtaccaaagtaccaaataccgatatcaaccaagcctccctggctacgatcaacagcgtgacggcacatgatctcgaggttgtaatccatgtcgtccaaatctccgaggttatgcatgtcaattttacgccacatcgatgggtctttacaaacacgacgccaagatctgcaaactttctgagcgttttcaagtatctcaatcgcgccaagacggtgcaggattgctgaagtcagttccggtggaagctccgtccagtttgtagattctccgacctccatcgccgccgggggtgaagacgaagaagccatttctaagtatcgaattgtcaagaattatcatcagtctctaattttacaattagatccttatggtatcacatatctacgaaaccagtttgggccaagcctagtttaatattgggccttggcctataattatattgtacccacagcaaaagttggcaagagcaacaaaaaacaaatgttctctccattgtttaggataggcctcggctaataaaccgaaccgaatgtaccaaaccgaaaccaaaccaaatcgaaccgaaaattgaaaaataaccgaagggaaactaaattctataaccgaaagaaccgaaaccgaatggataataaccgaaatattttgggtaaccgaaatatgttgggtaaccgaaaatatccggaatataaatatatttttaaaaatattagttatttctatactaaataactaaaaatagttgaaaatatatacaaaatggtaaacgtatttgaaaaataaccgaaaatatccaaaaatatctaaaaatattcaaaaataaccgaaatatccgaaaatattcaaagcaaaataacaaaatggatattaaattttaaaaccgaaagaaccaaaaccgaaccaaactttcaaaataaccgaatagatactaaattttagaaccgaaaaaccgataaccgaatggatataaccgtaaccgaatggataaatgaatgtgcaggactagttcaggaagattcaatatctaataccaataatagtcattggcatcatagagaaaagaggagacatgatcacatggaacgagttcaaaagttgataagacgattaaacccaaccctgtttttctcagagtatccacatgtcttcatcagctgaagcacaactcacacaccattatatgggtaatctgcggttgagtcaccggggcgtctcaactctttgatcatctccaaacatcgcttctcaagattcccgacaaggctaatcctgaaacacttgcgtacatcaaggtgttccaggtgaggacaaccgtcgagaatggcattcaagcctgtgttggttagtctgttagccataagctggaggtggtgtagtttgggcatgctttcagcaattgctaaagcatcatcatcacattcgagaggccccatatcgtctaacacgttgctgtcatacttgtcactggctggccataggcggcctaaggagtttagcttcaatgtctttagctgtgggcaagcgtggcctatagcttttaaatccagttttatacatgagtgagtgacctcgagggtttcaagcaatggaatttttgcaattgcgttcacaactcctagtttcgtcacccttggaaagcacattccaagtccaagacttctcagattccttgatctgcaaatatatgagttaaatcataaactataagaagaagaagagcaatatgttcttaaaaaaaacaataataataatattagaaattctcatagtactaatcaacttagaagcatgtaattaacaaaccatttgtttcaattgggacctaaaagatcaaactctaaagatgctttaagcaagtctatgataagaattctataagttgataatcttctaatctttttataattataataacctaactacttttttcattattaccatgacaaaggacaagtaattatgtatgatataacagtaactatgtgaaacaaaacaagacccgatcgaataaggactatattataacatcatcatatcaacggtgacttcaaaataaaactgatgctttaaaatagtatgcatatctaatcatatctatgcatacattctcgagtaaaagtaaatgtatacatatatatccaaattccttggcttaaaagatcaaagtgtaatgatgctttaagataggatctatcataagagttttataaggtaatgatattcttatatatgctaataacctaattacttgttttctataaccatgacaagtaaaatatatatatgatgatgatgatagagtaataacggtgtgaaacaaaacaagactagaatagtgtaagaacaaaggactattataaatttatatatagcagcgtcatagcatagaaattagcctcatatctaaaacactattaaggcatgaaaatctaaaacaactactatctaaaaacactataaaagcatgaaaattatccttcatatatatctgtttatatctaacccaaacgtagtaaaagaatatccaaagtccattcatagcagaccgccagatccggtaaaaggaaaaaaacatgataaactgagtttaattaacacataataaaccgaacgaaatcaacgattataagttatcaaatttttgccctagctaatcctcaggagaaaaatgaacaaacacattttagagatttcttttctgtcaaaatatatgtactaggaccatttgtgtctaattcacagacagtgaaatcaaataaaagccacataattctctaaatagcatttggagatttccatgaaaaaccgttcaaaggttgctagcgtgcttgcgaagggagagagagaacctatcggtaatgtagctgaggagagaatcgctcaagaagtgttcatcaacgttgatctctagcaagccaccctggctgagatcaacaatgtgacggcacatgctcacgaaatcaaagttgtacatgaggcagtctcgcgtgttgattttccgccacatcgaagggtctttacaaatgcgtcgccactctttacacaccttctgagcgttgtccagtatatcagtcaggctaagacgcagcaggatcgaagtcgtcagctccggcggaagatccacccagtttcttcgctctttcatcagcaacgactccaacgtagtggaggttgtcgttttcttgtttcttccttcttcatcttctttcatgaacaacgacagcaacgtagtggaggatgtcattttcgaggaggctgtcatttttgaggataagattaggtcaaattagtgaataagaagtgaagtgtatagtttcggacatttgagcttgcgtctctcattgaaaatttggtcgttgtagtatacggtaagattcatgccacgtattacgtataattgactcagcaacaattgaagagaaatagaagtcacgtgactccacttaaatacttcttcttgtgaaacctttcaccttcttactttagcttctctatttttatttttttacattttcacatgctcgcaatggtgtcttcttcactctcctgccgtccaaacgtaactttgtcctcaaggttcatagcaaaatccggagaggcttgcccgaatctgttaatagcttaaaatcacgcgttcaaagcttaataagtttagaaggaaataaggactttgtactaccaacaacatagagaaaaaaagaggagatacgaaggagttcataagttgacacaaccaacagaaaccacatgctctctgcattgttcagaaaatttcaatatctaataccaataatagtcactggcatcatagagaaaagaggagacatgaacgagttcataagttgacaagaccatcaaaagcaacgatgtgttcaatgatatcgagatgtaatcatcatctgaaccaccattgacacactgatactatacgggtaatccgcagttgagtcatggggccgtctcaactctttgatcctcttcatacatcgcttttcaagattcccgacaaggttaatgttgaaacacttgcgtacatcaaggtgttcttccaggtgaggacaaccgtcaagaatggcattcaagccagtgttggttagtccgttacccataagctggaggtggcgtagtttgggcatgctttcagcgattgctagagcatcatcatcacattcgagaaggggaatgtagcctacctggcttatgtcatgggccagctctgagcctaaggagtttagcttcaatgtctttagttgtgggcatgcatggcctattgcttttaaatccagtttaatcgaggagtggaagatcacgagagtttcaagcagtggaagtttctcgattccgttcattactcctttgttcgtcattggttcatagattgaaattccaagacttttcagattacatgatctgcaaataattacgtgaagagttaaatcattaagaagagtaacaacaatctgttattgaaaacaacgaacaaacacaattataaattcttatagtactaactactaatcaactcagaagcatgtaaaatatgaagaacaaagcataacatgtcacagaccaatgcctttgagtacatatggcttaaaaaaaatcaaactgtatgctttaagcaagtctatgacgagagttctataagataatgatattcttatatatgccaataacctaactacttgttttctttaaccatgacaaagtatatgtaattaattaagtatgatgagagtaatagtgtcaaacaaaacaagactagaacaatgtgagaacaaaggaccattataaatatataacagcgttatagctagcaacaattactttgaaaagaaaatttgaaaacatttactctaaaacactatcaaggcatgaaaattagtcttcatatatatgcatatctaatcatatctatgcacatattctcgtgtaaatgaccaaaagtaaatgaatatccaaagtccatggcttaaaaaatcaaactgtaatgatatgcttgaatcaaagctatcatatgagttttataagccaatgacattcttatatatgctaataacctaactactggggtttttcaacaattacaagtaaagttgtatatgatgatagagtaataacgttgtgaattgtgaaacgaaacaagactagaacaatattgtgagaacaaaggactattataaatttataacagcgtcataggatgaaaattagccttgatatctaaaacactaataaggcatttactctaaaacactattaaggcatgaaaagaatcgaaaacattaactctaaaactctatttaaggcatgaaaaattagccatcatatctgtgcatatccaaccgcaaacgtagtagtacatgaaactaaactttcaatcaatgaatatctaaagttcattcttagcagatcctgaggtctggtaaaagaaaaaagacataataacttagtttaactaagagagagagagaacctatcgacgatgtaactgaggagagaatcgctcacgaagtgttcaatgttaatctctagcaagccaccttggctgagatcaacaatgtgacggcacatgctctcgaaatcgaactcgtacatgaggcagtctcgcaagttgattttccgccacatggaagggtctttacagatacgtcgccacgctctgcacagtttccgagcgttatccagtatatcagtcacgctaagtcggagcaggatcgaagtcgtcaactccggcggaagatccacccagttgattcgctcttcatcgtctttcttcagaaacatagtggaggttgtccttctcttgtttctttgctcttcatcttctttcatcagcaacgactgcaacgtagtggaggttgccattttcttgtttcttcgctcttcgttttctttcatcatcagcaacgaggttctcatttgtgaggataagattaggtcaaattagtgaataataagtgaagtgtacgtagtttcggacatttgggcttctgtctctaattgaaaatctggtcgtcgtagtatacggttcgattcatgccacgtctgattaggtctcaataatcctgaagactcaagcaagtccagccacacatacttttgccaccacatcactgatatcgtcacgaacattcttagactcgttttttttttttttttttttttgactcgtttctatttaagtgtaacgtatcattccgtttgtttcttttcttttgatttaatgctaagattttataccaaataaaagtttacagagtaatctagcaagaacaaattaaaacttatttaacaaatttaaaaacttaaaaaagtttggttaatattttatatattatcagttatattttttggcatactttcaatttgataaattaaatagtgaataaatgataaatatatttagttagatgaataaatagttaaagtttaatgaataatatgcaaaaataggtgttaatattgcatcatgatttcaatacgcgctaacaaattcaaaataacttcaaaagaattttctttcatagttgatagtcctgatcactcaaattaggagatgccaatgagacgcttcacttggaagaacattcagattatgattcttcaattatggttacttcgagcatgcgagattttcaagaagtggtgccgtattgttctttagtactggatatgaggactcatggtctgctactcacgtggagtaacaagcgggaggagggtttagttaataagaagctgggtagagttcttaaaaaatcagaaggaaataaggactttgaaactaccaacatagagaaaagaggaaacatgaactgggttcataagttgacaagaccaacaaaaaccacatgttttctcgtcaatgttgagaaaattcagtatttaatacgaataatagtcactgtcatcatagagagaagaggaaacatgaacgagttcataagttgacaagaccatcaaaagcaaccatgtgtgttcagtgggaaagcgtggcctagatagttttcaaatccagtctaaacgatgagttgaagaactcgagggtttcaagcaatggaagttttcctttgtacgtcgtccttggttcataggttgaaagtccaagacttttcagatttcttgatctgcaaataattatgtgaagagttaaaccataaactaaaaagaagaataacaacgatatgttagcacaaaaaaataccataattagcaattctcatagtactaatcaactcagaagcataaaaatatgaagagcaaagaataactgtattgatgctttaaacaagtgtatgatatataagctaacgatattcttattatataactacttgttatctttaaccatgataaaggataagtagttaattaagtacgatgagagtagtaactgtgtgaaacaaaacaagactagaacaatgtgagaacaaaggactattaatagattcataacagcgggatagcatggaaattagccttcatatatctaaaacattattaaggcatgagattcgaaaacatttaattactcaaacactactaaggctttaagcaagtctatgatatataagccatcttaaaattttgttatttgtcatttgtttttttataatgaatattaatttttgataattgatttgccttataaaattatgaatacctgaattttttgaatctaatagaagcgggtcggatataaattttatactatatatgttaaatttgataaaatgattaatctcattttatatggatgatctgtaatggataaatgtggtaagttatagatgatctatctcaaaaaaaaaaaaagatgaacaattagttaaagttgaatgaatgatatgcaaaatatatattgtgttatttttttttggtaagatatatgctgagttattacaacaacgcagtttagcttcaatgtctttaatttagccgtggacaaaaatgtcttatataactttgaagttcagttacaccaccattattggtggtatcttaaccaaattttaggctaagatttgtgaaaaaagtaaaattatataagcctaaaaattcttatataagagctctttcttcacaaatcttagcataagaatttggctaaaataccaccaataatgatgctcttatatccacgaaatggaagttttgcgactgctttcacaagtccattaggcaccattcgccagcacattggaagtccaaggcttcttaattagattacttaattagacaaataattaggtaaatcataaactaattaagcagaataattttcttcatagtactgaccaaattagaagcgtatgttatgaacaatatgtattgtttaaattgggttcattaactagtacatgtatgagacataagagttttatgagcggatgttcttcttctgctaataaccttctacttttctcattaacacaaagtaagtgtgatgactcatgagacatgagctagagtgacaatgtgaaataaaactagttactgcaacatgcatgacttccaaacgtttcatcagcggaggcacggaagaagacgacggacaagaggaggaagaagccattcagtgaaataattaagaagtgaagtacatttttttgacgaagtgaagctctatcaagcttttcccattgtgtgtctctaatttacgatttggtactcaatagtataatgtatttatgaaaatcaaatcagtctaaagtatggtaagcccattgttttgagaataatattatggctctaggccgataaaaagcttgggactatgttcttaccatgtgatggaaattacaagctcaaaagtaaaagtggactcacacgtccactgtaactagggacttactgaaagaaagaggaaataacgagttcattaccactcaccattgatagtgtcaattcaacatgtctccttagtagtcataatacaggtctgaatgatcttagaagtcagctgaccttctgtagccgtactcagtgtcatcgctaccatatgagtaattttcctcttcttcgcctttttcgtcttctatcgaaccattatcggagaaaatgacataattgtaatcatcaagtacatcattggggcatctaaaatctttgatcctctccaaacattgtctctccaaatccccaaaaaggttaatgttgaaacactggcgtaaatcaaggcattccaggtgaggacaaccgtcgagaatggcattcaagccaatgttggttagtccgttactaataagctggaggtggagaagaccaggcatggtgtcagcaattgctagagcatcattgtcactctcatttagatgactccaaaaccccactagtttcaatgtcttcagatttggacaagcctggcctatagttttgaaatgctcttcttcgattgagcagtacaaaagctcgagttcttcaagcaatggcagtttcacgattgcttcaaaaattccaacactcgttatttgaccacctttaaccctaagacgtctcagattacttgatctgcaaagagttgcaataatgagttacaacatgatctattgtttataagaacaaaaataaagtatctcctagtacttatcaactcataagtataagagaccaagtagctgcaaaaattcgtgaaaacaattctaagctatgcaaagttgccctaatcattaagatggtcgtgagtttttgccctaatcattcctcacaatggaaaagaaacgttattatggttatttcattatatttcatataataaaatttggatgctcgtgagtttaagggtttataaagaacctctcggccatgtagttgagtagagaagtggtctgaaagcgccactgatcaatgttgaactcaagcaagcctccctggctgagatcaacgacgtgacgacaacaggcttccatagcgtaaatacagtacaatcttctcaggtttctcatgtcgattctacgccaaatcaatgggtctttagagacgcgtcgccacgatctgcatactttccgagcgttttcaagtatctccaatgggctaagacggagtagaattgaagacagcaaatccgggggtagctccgcccagtttgaaggcttttcttcgcctttcatcaccggaagctgggaagtagccaacggcggcgaagacgaggaagtaaccatgtctgaaaatcataaaatgatgtcaattctgtggaagttaaacaaagacaagtagtacttttccactgacctttcggcttccttctctaatttacaatttggtcctcgtagtattatgtttctatgagattgagtgcaggcaaaagtatattgaactgaaaaccccaatgtttttactttttacaataatattatgggcctgggccggtaattacagtatgaacttcgacgagttgggttacttcgttatcttgatataatatttttctcaacaagagctttgtgaccacaaaaatgttaaatctggtcaaaaagctaaactaagacaaagagagagacacacacacgtccgtctattaggcaagaatgaagtatctttaactctctctctctataaaattctatatgcatgacatcccaaagcactaccgctccatacggtttcgcttccttcatacagtttttaatttgacttcctcagaaaggatgagaacaagagatggatagactttttcaggatagaacaacaaaatcaccaacttcacttgttttttgtttttccatatcatttcaaaatctatctttccataccatgttttgccattgaaatattttttatcagaacccataaattttaaaaatttggatcgtaaaaagtcagaatctcaaatgttcttcatcatttgtagatcttaaaccttatttctcttctttgtgcttttttttcagtttggtttgttatataatttgactgtctaaacccgaaccggatcgtaccggtttgaccctaataataatgctacattcatgtacgatcaccataaaattgataatgagaaaccaaccaatccgaaagtaagaacaaatttacctctcaacacaattatttgcagaagaaaagacaaatataaagacacaaacagtttttaaaagagacaccaacataatcaaagtttcaacatcgtgatctaaaccatttcagaacaacaatcgaacaagagacttatcgaaataggcacaactacgataactcaaaatattattgtgtagtctacaaataaccaagaatctaagaacacctcaaatgatgcatcttaggtctatcttagactaatatcttagaattaaattttaaaaaataaagggtgagttaaaaatctatacatgcaccatcaaataattaagaatctatacatgaagaccatttattttggtaattttttcaactaaaatctatataacaaatatatccctataaagagatatgataaaaatcaggatagttagcagataacgcattatcgagataatatcgttagtaaaatatggatggagtttgatgaatggatgaaatgacatggagtacaaaccaacttaatatgttaataatatatttgacgatataaacaaattttcatgtattgaaccaatgtttagatttcaaagacatatatatatatatgcgaagacgataacattattattaaaaagtaacaaaatatttagcatgaagagcaaaaaagttgacttgcgactgaataatcatgtagaaaaaatacatgcatcaaaatagttagcagataacgtattatcaggataatattgttagcaaaatatggatgaggttttgatatatggatgaaaaaacttagggtacaaacctatttaacctgttaataatatagttgacgatataaacaaattaccagctattgaaccaacgatttgatttcaaagattttataattatggaaagatgataacattattattaaaaggtaacaacatatttaacgtcaagagcaaatatgatataggggtataagagtattttcatgatggagagaaaaggctcaacagtagctttttctgacacttaattttgtaatcttctatgtatacagagtgataatacccaaaaataaatcaaaacagattaaaaactaagatttgcttcttagctaagagtttattatgagtgacaaaaacagttatgtgtcatgttccaaaattttaattttaataatttttaagatgcaattggttcttaaccattggagatggtctaagtcatttggatttaaattatatatcttttaaaataaagtatcattaaaacaaaaaaaaataaaaaataatgtttaatttcactgaacaaattagatggtatgacaggtgtgagtcgatattaatacgaaacagtatacaacgggtgaaatcttagatatgacaatcaaaatacaattatatcatcttaaacacaaaattaacaaaacaatgaaatgtatgttattgttgaaatgtatgtagatataatctagattttaaattaatgaaatgtatgttattgttcctatatttttaaatgataaaattcaaacatagtaattgtatacttaataatatacatatataagacttgttttttttttatagatatttgatgtttatttgagaaaagaaaacattgagtagctaaaattcttctttaaacttgttatcattcaaacgtcattacaagaacacatagctctgtttttcttcttacacacactcatagagaaagcaacaaacattctctgttacacccacacgcctacaccttacctactacaagacatcaccttttgtagacaagcttcctactccatgatttaaggaaaaagcaaaagatactaaaaagtacttagttaaccaaacctctagttgtagtttctagttagtttccccaattccttctgtttggttttaacaacaaaaagacatcactcaacagttgtacatttagaaaatacaaaccaaaaaatctatttttaatctactaaacaaattaatttttcatttaaatatatatatatatatatggttctatggtgtacctcaggctaaaatctagtttctaactacataacaagaaacaattgtttgtactttaaatctaccacactataacattttattatgggattttagaataattcaagtgatacaatttgttataaaattaatgttttcgatatcaatcttgtattctttgcttggataattaatattcaatataatataatagcagattagtgtcactagtgcaaaatttggccatgtgatgcaattccatgtagaatagacatgttggtaaaatagtttttgtcgactcattgtcaattactgacaatattgtgtatccgtcatatactaaatcttcaattgaccaaacaaaatcttgatcaccacatacatcaaatataacttcatcttcatttctccaaaaattattgttaactaattctccaagtaattgtaaatatataggagatgtactttatgttattttcgcaacaagtaaactccccaccaaaaagaggatgaagatgttttccaaacctgttttgtgcaatccaaccttacgtgcttcctttctttggatcaacggtgaagttgggaagaagggagtcgatgctttcaccgagacagacatcaagggactcacatagacgagcctgcgagcttgagatatcttatagaaaatctgtcttatgacatttgcaaatgtatcaagttagcaaacactctgccaaaggattactattgaggcatgagcggctttcggtttagtatggcttatgtatggctggcttttctagtatttgatgaatgtttggaattgttttaatggtttttagattattgttttcggtttatgcattttgaattattgtgtgcaaattttcctatagtttttggattattgttttcagtttatggattttgatttatgttttttagaatttatattagataaaatttgttaaaaaaaaagagacatagataactttaaagtctacaactagagacaaaaaaaaaaataagaaatccacagagacaaaggaaattgatgaagtgctacggggctgttaaacggggttctcactgggatttgtatccttgttggcactatatgtaacctacaacttgaggccatagcttctcggcgttaaggcatgaaaaacgaatagaggcagatggaatggtggtagcgtgaagagcaagcaagtggacttgtatctttttgagtgcattttctttatttaccctattactactacttgacattcctttgatgatatcttttcgtttcagttttatgaaaattatagtttttaacaatgtttgatatttgttaaaatcttctatataatgaaaaaatagtatttttcaataaaacattttttatatagttagttaattacattatatgtgatggtccaacattaggatctaaaccgttgcagaacaacaaatgaacacaacacttattgatgtaggcaaaactacgaaaacacaaaaaaatctttgtttagccttcagatacccaagaatctaactcttcttgcttcgctgagaactctcaagtacgtctgcttcgaccaaaagctcaagcaacttcatcagaactctgatcctctttctgaaactcttcttccgctatcttaagaacctgaagccaaccactaccaggacatcacgtcaagataatcataaggaacagctgttttcaaaccaggaagcacactgagacggctctcaccaatcctcaattccaattcctcacattctccatgaatcttctcaagttctttccatgtatacatcaatggcaaagtagaaccacaccaagtattgatttctattagcttaacccttctctccttcgtcacttaaacatcaaaagtgtaactctctgattcaaattcaaacctaatcttatcatcaaagaactcttctaccaaccccttgagcaactccttctcattgagaagaacagggtaaaatgtagttacctcacgctggcaaatcccaacaagctcgttagatttcacaaagcatctaaattccatctcagccttcaacgaagggtaccagaagccaaagattttctattccaaaatgtaagccaaagattttctattccaaaatgtaagagcaatggattaacagtggcaaaccaaaaaaaaaaaagagaacactttgtcttgtttaaatcaggaccatgtagaaacaaaaaaaacattcaaatccataagttgaggagaacacttcatcaacaaaactacttagatcagccctctcctcattaacgtaccaaaaatagtgattttgcaacaactctgctggaaacattgtcatcttctcgaacacgcaacttgaagatcctaagcggttaatggagctttgttcagcctagatttccttggaaagacgcaagggtggtgatattttggggaagattgagaggtttaaggcagtctttaaacttggtcctctctcacactcatatgctgtcaaagtcttattttctgtgtataaaattctacaatctttttttgactattgtgtgcatatatatcattatcatctctagttcatttaaatatgtatggtcaaatgttgctcccttggttttaaaggtctgatataaaatattacatagaaagcccacttaggttcatggagaatccaacataaatttgtaagaataggtgaaaaaaatatatgatctaaatgagaattacaaacaaacgaactgaatctagcagtacctctcatgaactaaatgggggcgtctcaaaactttaatccactcaaaacatcacttcactatatcacctacaatgttaatgtttaaacactggtgtaacccgaggtttttcaggtgaggacaaccttcaagaatggcgttcaagcccgtctcggataatccgttcctgaaaagctggaggtggcgaagaccgggcattgtttcagcgattgctagagcaaccttatcacaacacttaacatcacccgtacagtttagctttaatgtcctcagatttggacaagactggcctacaacttttaactcttgttctctgattgatgacttgtatgtaatatcaagttcttcaagcaatgggagcttcatcgctgcttcgacaactcccctgctcaatactggagcacagtcaacaactccaagccgtctcagattacttgatctacaatatagagaattataacatgatcaataagacttgttctcgagttactcgcagaatatataccgataaacattattgaatactatgtaaacattaaacatatcagaattcatacaaaatttgcgtgtttgtgagttttagggtttagaaagaacctgtcggcaatgtaattgaggaacgaagtgttcaccaagtaatcaatgttgatctcaagcaagcctccctggctgagatcaacggcgcgacagcacaggggctcgataacgtaaaacaattctaccgagtttaccaagttttccttgattctgatgtcgattttacgccacatcgatgggtcttgacagacgcgtcgccacgatttgcacactctctgagcgttttgaagtatctcaatcgcaccgagtcggagcaggatcgatgacgtcagttccggcggtagctccgcccagtttctatactctccgttcttcatagcctgagggaaaggggaagaagacgacgaagacattctaaaggatacaattgccgtatccgtctctgttttacaatttagttcctcacggtaaaacttattttatacgaaactaatttgggccaagcatactgaaataatgtattgggcctaggcccacaatactgtttagacctcagaagattaacaatctgagaatccatttgattgttttctactcctaaacccggtagaacaaaggtgaagaataataatgtagatgaaacaaaacattcaacacttttattaacaaattgacttgtaacttgcaatgcatatattcccaaatacagtaaagagtaaaatcaatttccaaaagtgcattcaccaaaagtaaagagtaaaatcaatatccactctttttcttttgataatttgtgaatttttacacattaccaaaaggattgaacaaaaaaaaaaaatattaccaaaaggaaaagttatttacaatcttatttctttttatcaccttatattctgttcttgtgatagtcccggaccaatgaaatccggggccccatttaaattacgaaaacaaaatatttttgtcttaaaaactatagagtaaatagaaaaccaatttaaacaaaattttgaattatttatttaattgtatattagatttataaatattttggatcacacaattatttgtgatttatatgtataaaactaactattttctcttattatcaaaaattaatatatgcatatttaactaaaataaaatttttgttgggcccttttaaaatgggagccccattggaatgtttcatcttcatgtgttatggtccggctctactgatagtcaattatacagttaggtgatcacgtaaacaatcattaagagtctactagctagtgattattgatgatgttgtgatttgcatggggacaccataccttgtgttttggacattgttgatataaagatcaaatgaaattggtgatgaaacaccaagggaaaagtgttacacgattatattctctctatagctacgggtctactcaacattttttttaagctatcaatcgcaaggctttggattgatgctaaaattagtggttttcataagtaaatttaattaattataatattattacttttgatagtatgtaactaaacaatcgtgaaagtaatgtaccaactaaaaaaaatataaagacccatgacatcgttctcgaacgacttaaaatcacgccctcaaaacttcttaaaaaagttcaaaggaaagacactgaaactaccaagaaaggaaactgaaactattcataagtcaaacaacaaaggtgtcaattgtcaaaaacaaaaaacaaagcaacaacaacaaaggtatttccgcaagattcagaaagattcaatatctagtaccaatgatagtcggtttcattaaattgtgacccaaatgttgtcaccgcaccattatctgagccatcatctgaatcgtcatctgagtcattggggcatctcaagtctttgatcctctcaaaacatcgtttcttgagatccccaacaaggttgatgttgaaacactggcgtaaatcaaggtgttccaggtgaggacaaccatcaagaatggcgttcaagcccttattggttagcccgttccctaaaagctggaggtggcgtagttcaggcatgctttctgcaattgctttggcattatcatcaaacccactatttgaaaacatgatttcaggggctcggtttagcttcagtgtcttcagattcggacaagaccggcctatatctctcagagactctcctgaaaacaagcagtatgaaacctcaaggtattcaagcaacggtactttcgaaactgctttggcaactccctcatctgttattggaaagcaccttacaagtccaaggcttttcagattacttgacctgcaaataattgttactaaaaaagtcaaaaacataaccttattgagaacacttcgttgacaaaaccactaagcaaaccaaggtgctttatcagagattcagtagaaggatatagaacagataaaaataaatctagtttaaaaagagtgacacaaaatcctccaatcacttataacttcagaattagcaatcactcgaacccttggattagcaccgatcactcttagccctatagttagcaaacactctaaccctagtattagcaccgaccaaattctctttaacatggaaagagagctagggagaaacagaacctgtcagctatgtacatgatgagatcattagtaccgtagtaccaaatctcgatctcaatcaaaccaccgtggctacgatcaactgcgtgacggcacattgactcgaggtcgtacttgaaggctgccctatcattgcggttatctatgtcgatcttccgccacatcgaggggtctttgcagactcgatgccacggtttgcacactttttgagcgttttgaagtatctcaatagcgccaagacgaagtagaatcgatgacgtcaacttggacggaagctccgcccagtttctcaactttttgtctttcatcagcgaaggtaagggagttgacgacaacgaagacgacgaagcaatttttttagggtaaataaaattgtcagatctatgaaataagaagaagtggaagttacaaatacaatttatgccctaattaatcttcacgagggcaaaagcaataaatacatttattgtcacccaatgttgaagaataattcaaacacggtttggggatttcaatttctgttttaattgtaggacataatgagacgatgggtttgatgggtgcaattacgtttttttcttcttctacagattcatgtagtctcattctgaaaaagtatcagagacaatcattgaaaatcagagaataaagtaccattaagcaaatatgtttttgttctctgttcgacacatatgttataacaacaatgtagtatcacacctatgttccatcatctctgtttctgacactgatcaagtcagcgccaaatctctaaacaacactcggacacttccatcaaaactatcaggcctatatccataatatatctatttgatagctgaaaagtgaaaactaatgctagttccaacagaaactaaatattggggcacgaaattaagtcaaagtaaaccaggtgaggacaacgtcaagaatggcgtttaagactatgatggtgtctgttccctaaaaactcttgggtccaggcctgaaattacactcatccgttaaacgtggtaaatgaccggcattatatatgtgaagctaaataaataggctcaatatcaataaggagaatgaagacctctgacatcttaaaccttgtgacttgcattgcatgacatacatgttaaatctgttttctcaaaagctttacaaaagcagagagggacacaggagtcaactttaactactgacctaacaaaagagagaacataaacgctttcattaccagttgccactgatactgtcttgcattcttcaaagtgatcagataacgtacccttatttagtcataataagggttatatacatcgctatcatctgagtaaaagtcgtagtcgtcttctcctgctgaatatatatcggaagaggcatcaaaaggggaatcagcggttgagtcatcagggcgtctcaaatctctgatcctctcagaacagcgcttctcgagatccccgagaaggttaatgttgaagcagcggcgtaaatcaagatgtaccaagtgaacacagttgtcaagaatggcttccaatcttaagttggtcagtccgttcccaaaaagcttgaggtgtcgtaattcgggcatggtttcagcaattgctagaggttcatcatcgtatctccatagcttgaatctcggattccgctgcctcgacctgtgtggagccatttccatttttaatacttgtaaagatagatttcctttagccaaactactctacattgctctaaaccgctgtgcaggtaacgaagtcacggggatgcataaatttgcgtattcgtaggatatgtttcaccaataaccaattttggacgaatttaagacaacagatttcctttgtttaaaatcaacataaatacttatattcagtacatctacaactaggtttacggaaacaaaaaacaaaatcgcaattagtttgtgatcaactaaattttatattaatagctaaattttcaatacacaatagctttgtattttatataattaattaatgtacatctatttctcacatcaagttaccataaattatagaaactattatgagaatgttgcacatttaggcacattcaacatgatagtgacttctccaattgtataccctgtttattgatgctgatttccccaaaaatatccaaatcaaagtttactgttagatatgtttctctggatacaataatgtggaattatgaacgattcgtattaaaaaaaatacatcataaatggcgaaataaagctatacttggattcaaattaaacaaacaatactttcaatcagtacatctactaattgcaataaaaaacataatttgaaaaaccaaatataattacacaacttggattagaactactagtcctgttaaaacaacatctccatttggatgtgaagttctggatagagtaacaggtaggcacatatctcctcccaaccttgcttccatttgatgttgtcaagatttttgaaatttgcttatcaactttcggaagtactggacctgaatgtgcttgtgacttcttctgacgcgcattgaaccaacgagttaacatagacctaataaatcttatcaattccataatattgctagtcatcagattgaaacgctgaccaggaaaatatagccttgtccattgagtcaaccctatgtcatgtagatactttatgcaaagggggttaatggcattaatctgaccatcaattgttttaaactttccacttgtaaactcatatccaacgtttttcactagctgcgtcaatcctttgttcttgaacttggttggacattgctacataggtgaataatacatgcaccatgcatgatgagcgagcggaaataccttctttatacctacttttatcgatttgtgcctatctaataatatagtcagtgttgttgtcggctattatccgctccaactttgtaaagaaccaagtccatgcatcatcattctcgctatccaccacagcaaatgctagtggatacacttggaagtttgcatcttgaccacttgttgtgagtaaaatgcccttgtgctttcctttcaaatgtgatccatccacaaccaatacccttctcaaatgcttaaaaccttgtattgaagccccaaaagctaaaaacatatacaaaaacctctctttcctttcatcttcaatatctggttctgtttctatatgtgttatagttcccggatttgttaactttagaagatgcaaatattcagccaaattgtcgtaagactcttcatcactctcggccacatctgttaaagctgattccctacctctctaacactttgtgtatgacgcagaaaccctcaaatcttctagtacaagttgctcaagatccagcgggacaagaccatttgaaggttcactgtattttgccttaaatacatatgcatttacctttgatgttgccttcttcatgtattgcttcctagtctctaccaaacatgtgtgttgaagattggctttcttaattacatagtaacctttgccattcattagagtcgccaatattctccaatcacatttctcatgtgagcaactaagaacaaaataattccactttgttcttgtttgcttgaaatgaaacacattctttattgcatatatagccaatcctatttggcaatcgtctttgcttgcatacacttttccctggtatatccttttaccatcatcatcaatgtccaaatcagataagttatctacttcatactcgatgtcctcaaacaaaggtgggatgtcaaactcctcgtcatccacttcctctaactttctgacccccttcttcagtccctgagagcttccaactcgaccaaccatcttatctttcataacatgttctttcttttttgcatgctctgtctttatccctgctccagccccattgacatatacaacgtggtcaaagactctgctgccagtacacaaaactacttcatccggattggtgcccacaaccttattgtaagacccgtaccttacatctaaacctcccgttgccatcaactcctcaacattggagccaccataatcatctgctaagaaatttgaccaaaattccttatcataaccgccacagggcatactataatcaagcttttccatctctactttaatttcctctttgtcgttgtcagcgaaaaaatatttttcatcatcaatgctaataccttcgttctgagtatcatcccgggacgatttcagaccacttttacttattagttttgcttctacttgttccaattcctccatgaattcgtcatcaccaagaaatcacgttgttagctacttaattcggcgactgattatgtagtcgtaagttttggcaactaaatagtgacgtattagcgactaattagtctatattatacaatagtcgctaatcagtcttgaatgtgagactcattaatttagtcgctaataggtcaccaagtacagctaccatttagcgactcatatgttttatttgggcaattaattgggctttcacatgcttgatttagtaacgatccagtaaagttagccctaaacccagactatataaacgattttacgcctaaccctaaccctaatcccccttctcttcactctctcactctcgacgaaccctaacctaaccctaatcccctttcgatcctaaacttcatcaatccatcttcaatcttctcaatctctcgtttcttagcttcaagtgatgaagacatgtggtggaggcaagagaggaagaggaagtgtatcaaacattccctcaaatcgacccacttcttcccagccagttcgagttgaaccgaagactagggcatcaaatcgaaggcccagtggtcatcccagccactacgagttcacgctggtgattcgtccagccccgcttcaagattttgaacatcatccgactgcacagccttcaacgggtccatccgtcagggactatcctcctccgacgcaacttttccagtcaggcgaagggtctcctcgcggatcttgttctcctcgtggatctggatcgactctgttttgagcatccggctcgactcaacctagatctggaggatctgttcatcgtctagcctctacggcgagacaatctccagcggcggttcacaagaatgcctccaatcagtctatagcgctggttcaacgagaagcatccaatcctctacttccgcaagcctcaaatcctctacctcgagcctatgtatctcatcacagctctcaagctcaaaactcacacgcggaggaagatgaagatgatgatgctgagtttgtggctgatcttgaaagggaatcaactctccctgaagctttgcttgcaaatctacatgacatgcttgcccagccaggccgtgagaagtatacaacggttatctctcccacatttgagcctctaaccgtatggtaagctgagaatattagggagagttgctaagttgattaggtgtgtaatatgtgtgtgttaagtgtgtgaaaccctatggtaagcttagtttattaagttgattaggtgtttaataagttgattagaataagagttaatattgagtaatgtgtgtgtgtatcctcaaagttgattaggtgtgtaatatatttaataagttgattaggttaagcgttaatattgagtaatgtgtgtatatatgctaagttgattaggtttgtatatgctaattggtttatgtaattgaaggtttggtcacgacaatggtaagctgacccggaagatcacaaaggtcttcacaaacaagtttaatgggccattttacagttggagctgtgtacctactgaaagaagacacatatacttcctcgaattcgcaataaattaacttctatctcttattaatctcttacatttggtttggtttggttgtttgatcactaacatcaaactctcctcttgttttgtagagtacacacacatggcatccatcactgactggtgtagttgaagaaaaattctttaaaatatgtcaaacgcgtatgaaggacatggtttctaaggcttgcgcaaaacgtgcaaatgagcgaccgccatggattgagaagacattgtggaaggaaatgtgtgcgtattgggacacaaaagaagccattgccaagagttcaaccacatcagcagcttgaatgtctgaccgtaatggtcctggtcctcacaaacatgtatcggggccaaagtctttcttacagattgagcaagagatagtaagttacatttgtttatttatagaatgatttttattaagagtctgaattgttttgtgaacaacatttcaggaaattgagttgggaagaccacctactattggtgagatattcgttaagactcataccaaaaaagatgggacttttgttgataggaaggcgcatgaaattcatgaggcatatttgaggaacaaggaagctaagttggctgcccgtgagaatgatgaagggtcagatggtacttcccgtcgatcagaactatctcaggaggaggatgatgaggtcttccttcaggtaatggtcttgttcctcttgtcttttttttatattatcacttgcttcatcttttctacaataatcctcttgtcttttgtttgcagtcaactgtcacaaacaagagatgggtatactttggaatgggaagcttagggaggtacatcaatggaaagcggaagtacccaggctgcagttctgctttcactaccttgcagtcacagctttaggaagccaactgcaagatagaagaacaagcgactctccaggcacatcgtgaggcagaggcattgagggtgaaagctgagcaagcagatatcaagcgtgttgctaatgagcaacaagaagagatcaaacacttgaggatggttaagaagtacttgacagaaagagaccccaagtttctcgcattcctcgagtctgctggtgctactgcttctgcttcggaagatcaaacagaggatgtccagactgctactgcttcacaagatccaccccaggagtgaacatctcatttccccttcctttagttgcttttcttatcaaacttaagaacttgtattaatgtgtgtgtatttgaattaaggttcggagtttataaaatacagcttgttagttaattacagttttgtttgtgaaatacagttttttagttgctttatcaagtttgttaattacagttttaactaaaaacagaatgtataatcgataattcaacctgtaaccagtcgtcaaatagtcgcaattcagtcaccaatacttagtcgccaagtagtggcaaaacagtcaccacattagtcaccaaagagtcgcttaagtgtcaatatatagtggtaaccatgtcgcctaacagtcgcacgatttggcgactaattaatatagcgacgcatggattaccgactaggtgttttagtcgccaaatagtcgtgttattagatttagcgactactaagctaccttttgtgttgtcactaattacctgttttcttgtagtaacaggagtcaacaaaacttttgtattttttgaaccaggagatgatatatcgcgagcaactttgtcaccacttttacttcctaggtttccttctgcttgttcaaatacctcaatgaattcgtcatcaccaggagtcaacaaaactttaggggtttctaaacccgcagacgatatatcgcgaccaactttgacacgcacttttggaaaactttgtgactcaaaactacactgacgctttcgtttcgtgctactatcttcgcgtgcatcaaaactctgtaaatgttcatcactcgcagccacaagttttgatgtttcatccctttcctcaaacttcacaaacaaatttagacccgtgttttctctaagtggacttagatagtatagaaggccaacctcgcttgtaactataactggaggagtcttttccttagttgtaaacatctacttatccggcaaaacgtaactcagcaaaggatttacaccattcattccaaactcctccgaaatcgctgccttcaacgctgctaatgtcattccttaagaaattggaaaaaccctagaaaacaatttgttacaaatctccagtttccactctccattcgaagaacaaacccaatctccacaaattacaatacataattcatccatcattccctaatcaaacaaaacagagcattcacattaattaccgattagggtaagagatatttgttaatgcattacgattttaggataatttaggcatagatcgtaccttcgtcgtcaaagaaacaaagttgtgactgaattacaaccgtctgtgtaattgtttgaggtaacttccttgatcatctttgtcgacaaaaaaaactcgtctatcgtgtttgccacatgttttcttttgataccaaatcaaaccaaacatatcaaaccggttaagcaattaatgatttaattggagaaggatataattgtcttttttctccaaaaagaaggaaaagtgtttgatccctacaaagtgccttaaacgtaaaaactttctttaaaagtgcctaatagtgcaacattctccttttcttttttttaaagtctcataaacgagactttcaaacaaaagattctcaaaaggttttttttcttcttcctaggggtgtcaaaatgggtaacccaacccaacccaactcataatcaaatgagtttatgattaaatgagttatgggttagacccaactcatttaacaaaatgagttgggtcaacccataactcatttcatttgatgggttgagttgttaaatgggttaaccatttaaataataatttaattaattaatattataaaacaataataaataattattatcatcattaattcattattattaaatttgagatatttattgattcagaaatttttatgagtttacatttttagacgggaaaatcacggggtcatgtttttttggcgggaaaatcacgaagttacgtttttggcgagaaaatcacgaggtttacgttttttgcgcgaaaattacggtttacgttttttacaataaaactaatgaattgtaacatgatccggtcaataaaactttagtaaaaaaacttcactttattacaatagttcatgagttttgaacaaaacacaaatgaaaacctcactaacactctcacgatcgaataacaatcgtctcttccttgtcatctgcaattcataaccaagaaatatattaagatcacataacagtagaagaatatgagaaataaaattgtatcataccttcttcatcactcacaaaaccgtagagccatgaccgagtacataacaaagcttgaacattggtcggaagaagacgacttcgatatttatttaggacatgagaccctatactaaaagaagattcagacgccacgcttgtgatgggaatactaagtacatccattgccatgtacgccaacgcaccaaaacgaagtctgttctctttccaatattgcaaaacatttaaattaggatgatttttcatctctaattttgggtcctccaaatacatatctaaggctgattttccttcttcaacttctggaacatcatctaagtcaaacaaatcctataacatgaatagctaacatgttaacatttagctaagacaacaaatcaagagtgacgttcaaaatgaaatcgtcgatttactaactatactcattttcatcaacccactcaattatactagctaccaacaggaacgatgaatacgtaattagataaactaataaggcaataatagaaaatgtcaaagttaagtacttacatctaacacgtccaagttgtcacttcctcgttctgaaacacgagaacctgctcttgtagaactaacgacgggagtcacaggaaatgcttttctatattctccaaaaagctctgtaatcttagtctcgaggaaatctattttttcttgtgaagtggttggatcaagctcatcataacatcgctttagaagtttgaatttcattctcggatccaaaacagccctcattgcaagaataacactatactctttccagtatttatcaaatttcagtctcatcttaaaaatcatctctcggactactttatcttcgttgtttgatgaacttccaacaaacactgaatcttccaaacatgaccaaaatataaatttgaagttgaatagcttctcccagacatcaaattagtgatcttgtaaaatggcatcaagatctcatgaatagtctttgctctcttccattcttcactcgagggacagttcttatagtttttatcaactatcttaaacctatttagtgcacgttgatacttcaaagctttgtgaagcatcaaatatgttgaattccatcgagtttgcacatctaatgatagaagcacttcccctttcccttctacacattctgcaagtgctaatcgcctagatgtcgaccctttgacatacttaacagtctctcttatcttagacaatgcatcgctaatcacatctaaaccgttttggacaatacggtttaagacatgtgcacagcaacgcacatgaaagaattcccctttgcacatcaaattattatccaacttaagacgatctatcaatacttcttgcatactattatttgctgtagcattatccaaagtaagggtaaacaccttcttttctattccccactctttcaaacattcatggatcttactagctaaagcatcaccagtatgcggaggaagcatgtcagaaaacgataagattttgctattcaatatccatcttgtatccacgtaatgtgcagttaaaacaatataaccatctccaccaagtgaagtccaacaatcagaagtcaaacaaatcctactaggaatcctttctaactcagattttagaatctgtttttccttttcccaagtcttaaccacatcagctgcagcagtattcctagtatagcacttataatctggattcatataactaatgaaatctctaagctcttcatattcgacacaaagaaaaggaagatcatgtcgaataatcactcgactaaacttttctctgacaactttatgatctatcttcgttgtctttcttccaacatctaaacccattgagcatttcctatgatgacgaatcagatttgatgttccagtagttggcaatatcgggtagggcttcaagcatttcttacaatatgctatttttccatcattctcatcttctagtgtaaagtaatcccacatatctgatgttctacttcttttaaaacgagaagcacttactaaacttttagattgtgatgtatctgctgatgtttgcccaccttcaccaccataagtacattcgtcttcattgtccattttttgtaaaagatcagctgcaaataactatacatagaaataaggccaagttagagattgcttaataaaacctgttattagccaaatacaagaattaatcacatagacacagtcaaagaatcaataaaacaaagagaaaagaagactgttttggacaatacggcaagcatatgactaaatacgatttttgttagctcttgttattctaaaaatatttctacactgagtgtaactctgattagacatgatacattaaaaatttggttaagttagatcatgaacatgatttcccaaaccaagaggagacgtgatagacatcatctttgaccctagacataagctgaaatatcttctttcagcttaaaccctttaccgaaacaaacacataacaatttggcaatcacatcaaaactatcagaagtaactaatcccagaactcaaacttcatcgctcaagtaccacaaactagaagaagactagtctattaaaggtagagccattcaaataaagtgaaaattaaccaaaagaacagtctaactaaattgatcctaaaagaatagtcaaagcacacacacaagaacagtctctcttatcttaaccaaaattcaatcctaacttagtatcccttagattgaatcaccaaagccttcaagttaaactcaattgatcaaccaaatgaacaaaactcaaggatcttaaacactaactaaaacccttaagaactcaatgtttcgaatgaaggcttaacttgtttaaaataatttgttcttagaggattcaaattaagagctaaacaacactaacgcatacagaatctgaactttcacgccaattcgaatgaagaaaacgaaaaagaacttagaaatgagaagggtccagtggaaacatacctcacccttttgacccactacaagcacatcatcatcgtcgtcttcaattgaagcagtcttcgtcgtcttgtcagtctccgatgtggatgagaccggtggagagtataggtcgaagtggaggtcgagaaacgattgatttcttaaatttggggatgattttattaaattggtttagatgtgttggttaaatattggtttagagattttagttggtttaattcaattttacaaaatttgatgggttaattgggtaaaccactaaaaccattaacccattacaacccaactcattttactcatcaaaccaattgactcatcaactcatttgacccatcaactcatttgagtcaaaaatttcaacccattagggttcatgggttgaattgagttgagttgacccatgaattttgacccattttgacacccctacttcttcccaacataattaaaaactctctacaagttacatatatttttttcacaaaacatttttgaaaaataattgttatcaattttctatctttcttttaagatccatttcactaataattttatttcactaataattattttattatttggttaatcagtaataaagtttttgatttttttgataagtcaaacttatacaattactcaataaaaaatattattcagaaatttaacaatcaactcggagctaatttagaggggcaacatctaaaaacagtttagattatttgaagatgtagtacaagatatattataatgatcctcaagctccacgccttcatccaagttttattaagtttatcccacttcttactaatttctttggatattaagtctctgcataaaacaataaatgtatcttttaagaatttttatttcttattttatttctaaacctttgtcatttctttaacataaatattttaaattaacaatttcatttttagtaaatccaacttcatgatgcaatgtttggtttctaaaaaataaatgaataatacatattttttaaatcattaataaaatttattgttagataaatttatttctaaatatattttatttattattattattaataacaagcacgtacagcttctacagcattgttttaccaattagattttaatagccaaagtttctacagccgaagtctttacagccaaattctctatagctcggatttttaaagtcaaagcctgtaaagccaaaactaacagtcgctatcaatcggcccctagtccttccgagacgtgaaacagagcaaatgtaactcgattatacttaacagtatggtgcattttatctgagctccatcgtgagcaagccaaaccattatggtgcattttataatcacacaactcgattatacttaacagtaaacccaattgggatctagtataaatcagccatgaagtcaaggctcagaatgatgatatatttgttccaaccaaaaggtatttggtattaaatgttcaaataaaaattatgtggagttttttttggaaattttttcgattaagttttaaactataaaaataaatataattgattataagaagataagtgagatatgggtttcttaatagtttttcttgtttaaaaagactatatctcgtttcttctttatttgcttatgagtgattatgagtctctaattaacaaactatcaatggaggtgctcttaggggattataaaatcactttctagttcttttttccttcttatataggtcgtcgaggtcgaacttcgtcctccgagattggtggtaacttctacttaaacttttgttggattgcttagaccaaattgttggggtgattggcaagtgaatttcaaggctttaaaaagagtctaaactctttcagttttttttgttgccaattaggctttttactttctttttttaagtttttaaagccttcttttttttctcttcatttctcttcttttttttaaagtccaataatagaggctttcacacaaataatttttaaaagtttttttgatcttctcccagcataattaaaaactatctacaaattaaatatactttcttcacaaaatgtttttgataaattaattattatctattttctatctttcttttaagatctatttcactaataattttatttcactaataatcattttattatttggttcattattaataaatttgttgatttttttgataagtctaacttatacaattactcaataaaaaaaaacattcaaaacagttttcagaaaaacaatttagccataatattctaataaaatgtattgttttagaatatttatttcttattttaattctaaacagctgtcatttctttaaaagaaatattttatttattaacaatttgtttttagtaaatccaacttcataatgcaatgtttggtttttaaaaactgaatgaataataatattttaaaaatcattaaaaacaattcttgttacataaatttagttctaaatttattttatttattataatatatataataataataataaataacatccacaacttctattgctttgttttaccaatcagattttaagagtcaaagtttttacatccgaagtctttacaaccaaattctttgcagctcaaacttttaaagtcaaatcttctaaagccataactagcagtcgctactaatcggcccatgtagcttctcaaagatattgtggtaattggtaaacaacaatgaccaactcaaaggaaaatctaattgatcgttaatgactctatattacatcttataatcttactacaacaaaaaaatgtttcctaatgatgataaataagatatcaaacacaatttattttggttttattattttttcaaaagtttttagtaggaggaggattgaggaaaaaacatttccatcgttatcacttacctaagttaccaaatacaactatatccggtgatatcaaaatgtgcattggaccttttgttagtggaccatcaacatatcatgtaaatatgatatcctatacatcaatggtgattggcaggagactttcaaggctttaagagtgttgtaaagggggtgattggaagggactattagttttgactgtaaagactttcgctttaagaactttggtataacaaactttgactgcaaagactttcgatttaagaactttggatgttaaaatctgattggtataacaaaactgtagaagttgtgactgttattttttaaaaattatatatgtttttaaaatagaaataatgttataaatgaatttatttgacaatataattttattaatggtaagaattaaaaaaccaaatacaacaatcataaataaatgcatagaaaaatatttattattcatttatgtttaataaccaaacattggattaaaaagtggataaactaaaaatcaaattattaaaaataaaatatttatttaaaagaaataacaaaggtgattatgaaaataaaataataattattaaaatggatcttaaaagaaagaatgaaaaatgataataaataatttatcaaaaaatatttgtgaaacaatatatgtaaacatgtagaaagattttagttattatgaggaaaagaaaaacaaaacttttaattattatttattttaatgttttattatttgtttgaaagcctcatatttgagactttagaaatctattggtaaggatggctgtaaagactttggctttaaaaacttttgctgtagaaaatttggatgtacagacttaattgttgagactttagttgttaaattctgattggtaatatagagctctaaaagctgtgagtactattttttattattattaaatatatttttataaataataatatgttaaaattgaattatgtttaaacatagtgacacaaatatattttattaataatataaaaataaaatacaaaacatattcttaaataaatattctcaacaaataaactgcacatgtaataaataaactatttattagtaaaatggatcttaaaagaaagatataaaattaataataattaattaatcaaaattgatttgtgaaaaaatatatataaaattatagagagtttttaattatcatgggagaaaaaaaagaaaggttatttgtttgaaagccatgtaatcgttacttaaaaaagggaaatttgcaaaactacccttcttttactaccttttgcaacaatacccttttatgttgtccatttttaaaaatacccttcttttgaacagaatgaccaaattactctcatctaataggaacaagtaattggaaactgaaattttcaaacaaatttttttggcgccaaaatgtttttttcccgccaaaaaataaataccgccaaacttttttcccaccaaaaaaaaaaattgctgccaaaaaaaatatttcccgccaaattttgtttttcgtaacaatattttttcagccaaaaaaatgtttttaaaaatccttgtaattttttttaacgggaaaaagatttacaagtgattttaaaagggttttaaaagatatataacgggttttaaaagggtttaaaaatatatataaggaattttaaaagtgtttaaaaatatttacacggtattttaaaagagttttaaaatatttacaagagattttaaaagggttttaaaatatttacaaatgattttaaaagggttttaaaatatttacaacagattttaaaagattttataaagatttacataaatttttaaaggttcttcttgtaaattctctaaaaatcttataaaaactcttatacatcttttaaaactctataaaaatctcttctaaatctttttaaactcttttaaaatccctaataaatcttttagcacacttttaaagtctttaaaaatcttttaaaaacttttgtaaatcttttaaagccctttaaaatcccttgtaaatattttaaaacccttttaaaatcccttgtaaatcttttgtaaatattttaaaaccgttttaaaacaattttaaaccgtttaaaaatctttaaaaaacctttgtaaatcttttaaagtcctttaaaatcccttgtaaatattttaaaacccttttaaattctcttctaaatcttttaaaactcttttaaaatccctcgtaaatattttaaaaaccttttaaaacaattttaaaccctttaaaaaacctttgtaaatcttttaaagccctttaaaatctcttgtaaatcttttaaaacttttttaaaatcccttgtaaatcttttaaaacccttttaaaatctcttgtaaatattttaaaatccttttataaccccttgtaaatctatttcccgccaaaaaattttttttttccgagaatatgttttttgaagaaaacattatggcgagaatttttttttcgaaaacttttggcgggaatttttttttcgaaatgttttgtcgggaaattgattttagaatattttaggcaaaaacaattaatatttcattttgttaacctaaaacaatttctaagtaagggtaaaatggtcattaaaaatttaaagagggtataaatgtaaatggctaaaaaaagggttgaattgaaaaggggcatcatgaaaagggtattagaaagaatttttatcaaaaaaaaaaaggagatttcaaatctcagatttgcaaaactatcatttttttactactcttttgcaacaataaccttttatgttgtccatttttaaaataccccttctcttaaatagaatgaccaaattaccttcatctaataggaacatgtaattggaaactgaaaatttcccgccaaatttatttttcccttcaaaaaaaaaaatttcgctaaacttttttcccgccaaaaaacaatttttccgccatatttttttttcgtaacaaatttgttctcagctaaaaaatgcttttaaaaaaccttgtaatttttttttggcgggaaatagatttacaagggattttaaaagggttttaaaagatttacaacggattttaaaagggttttaaattgggaaaaatgtcataaaaatcatcactttacaaaaagtggtgaaaaaagcttgaattttacttctggtgaattaaattaccaactttcattgactttccaattaaatcgttaatttttattgactttgccaaataaggtatgtcgttaagtcaactaacagactaatttagtggagttagtcaacgttaattgattccgttaaaactctaaaacgacgtagttttgtgattttcttttgatatttaaaaaacaaaaagttgaagtcacagtggtttgaaccttctacctttacgatatacgacgagatatatagccatctcaactaaaacgtttttatgaaaattttacacaaagtaatttatatcagtatctctctctcatctcctaataaacctaatcgcttttcttctctttaaacagccgcaacctcccttataagtcataactcgtaagcataggcagctccctcatcacacgtccgttactcgcaccacttagaaaccttgccacttctctcaaacattgtctccttagagatcctccattgatgattacattatcattgccgtttaaaagaaactgtgctggattgatatagatgatggtggaattgatgacgaattccgcatagtagtagtctccattggcattgtttcactctagatttgattctttaatttcaaggggaaaaaacctaaattattgaaattagtttaaggttacgttttaaaagttaacgattcaatctgagaaaatgaaatcgggattattatggtttcaagcgtattgtataatctagagagagagatgctaaactacctatataaattagtttgtgtaatattttcataaaaatgtttcggttcagagggcaatatatcaaatcgtaaatcgttaaggtgggaggttcgaacttctgtgatctcaaacttttgttttttttaaatatcaaaagaaatttacaaaactccgtcgttttacagttttaacggaatcaattaacgttgactaactccactaaattagtccgtcagttgacttaacgacatgccttatttggcaaagtcaataaaaattaacgatttaattagaaagtcaatgaaagttgaaaatttaatttaccaggagtaaagttcaagcttttttcaccactttttgtaaagtgatgatttttatgacatttttcccgttttaaattcccttttacaagatttacaagggattttaaaatgatttaaaaagatttataagggattttaaaagggaaaaaaaaattttggcgaaaaattgttttttcgaaaatttttggcaggaaatttattttggaatattttaggcgaaaaatattatttcattttgttaacctaaaacaatttcaaaataggagtaaaatggtcattaaaaatttaaagagggtagtaatgaaaatagattaaaaaatggtagaattgaaaaagggcatcatgaaaagggcattagaaagaagttttttaaaaaaaggaaaacaaagaacaaaataaaacaaggccttgagaacttttttaaaaaataaagtcaagaaagcatgattgttaaaataaaaactgtgaggacttttaaagccacggaagcctcttcccaatcacccgcgtaaaaatgaaaaaactggacagttagactttcaaaactttaaaaaaacgtaaagtcttgaaattgtgattggtaaatattcgacttttaagactttaaaaaaaatctaaagcccttaaagtgtcttccaatcacccccaaagtgtctacagatttatttttgtcaatcatgctttttttactttatttattttgaaagttctcaaagccttatttttattttttattttttttctttatttctcttctttttgtatagtcttgaatacatggctttcaaacaaataaaattaaaaactttcttttttgttctccccatgataacttaaaaactctccacaagtttatatatatttttcacaaatcagttttaataaattaattattattaattttctatctttcttttaaaatctattttactaataattattatatttttatcaccaacgttaatgtaaatgtaagagagtttacataattagcatttttcaaaaaccatacacgattcatataggccattcaaaaatatgaataacaataaaaaaggtttaagtgctattcagaaataaagaattcttcagaatattaacaattatgtttgaagtaaatttgtgtttggaagtgtaagagagtttacataattagcattttcagaaatcatatactgtttatataggccattcaaaaatatgaataagaataaaaaaggtttaagtgctattcagaaaataaataattcttcagaatattaacaattattttggaaataatttgtgttggaaacatgggaaaaatcgtttggatagtttgacgaagcaaaacaacatatatcataataatctcgaaacaccataattttctcagtttatcccacttcttaatgtaatttttggttactaagagaataaatgaatgagtaagacatatgtattttgtttgttgaggatatttatttcgtcatttattttaaaaaatgttgtattttaattttttattattattaaaatatatgttttgtcactatgttacaacataattcaattttgatatcatttatatttataaatatatttaataataataaatataagtaaataaaattcacagcttctacaactttttgttaccataattttctacaacataattttttaaagtcgaagtctctacagccaaactttctacaacataattttttaaagtcgaagtctttacagccacccttattgtattaagtcttaatatagtataaaaataattactttatatatctaaacagaaaataaaacatagaaaatatagtatatctattttattacgtaaaaaagttagaatatgttttgttgtacaataaaaaatgtaatgaaactcatactaaaaatttactcttttacatgtgcaaattgcaggaattatatcgagaatcattgttgcttttaaaatttaataatcaatgatatgtttttaaataaatttaactctcagataaattaacaatttatttttgaaacttatggttttaaatgattggttttgataatttatatgtttgttgtgtttattcattatatgtgaatacttagctaataaaacgggatttgtaaaacaaatatttactaatatatacacgtttataaattcttccatacactaaccgacaacgtatatactaacacatgacgttttacaaacacacaacgtatacaactatacatactataagattcatttatactataagattcaaatttgatatagactttaatactttgtaaattgggaaatatgtcagaaaaatcgccaattttcaaaaataggacgaaaaaatctccaactcctcaaacgtcgttttaatcacaaacttttggttgacttttccagaaaatacaaaagtttggttgacttggccaaattagtcatcacgttaagtctccgttaggacgacgattacagggttaataagccgttaagggcttccgtcttagcaaaacgacatcgtttctataatgacaaaatgagccataatcgatagaaacgtcgtcgttttgattcagagagatttgagaaattcccaaatcgattagaaaccctaaaagagagaaaattctgaaattctctcaatctctttccaattgatcccgatggcgaagacgcggggaggaaactggaatcctcgtcggtcgcggaggctaatggctattgcaggcgaagctaacagagcaaacataacgaatcgaccaccgaaagttgttgagatctcagaagaactggagacaaatcaaaacccagaagaaaccgcgatgaatcagatcccagaagaaactgcgacgaatcgaaacccagaagaaactgcgacgaatcgaaacccagaagacaatgtgggtgggactgttggtgaagacaatgttggtgaagacgatatggatggaggtctagaggaggaaaattgtgatgattttgaagcagattttggtgttggtgcaagagaagatggagatgcaagcaacactgatgctgacagtggaggtaaagattgtgatccccaatccacacacacttcgatggcacatcacattctccggtgactccagatgtaacagagcttgaactcattgttagagagagagagatcgaattgaagaatagaaattttagggattgaaatctgaaatcgatttgggggtttttagagtctcatctgtcattacaaaaacgatgtcgttttgctaacccggaagccgttaacggcttattaacctcataatcatcgtcctaacagagacttaacgcgatgactaatttggccaggtaaccaaactttggtattttctggaaagtcaaccaaaagttttgtgattaaaacgacatttccggagttggaaatttttccatgcaatttttgaaggttgaagatttttctaacattttccctttgtaaattatagaagataacattttatccacactaagaatccatcaaattagtataagatattaccaaaataacagacgaattaaaatgttatctcgtgcaaagcacatggtactgacctatattaatgagaatggtatgaaatttttgttattttaattacttttacatattaattattctacacaatttatgaaatactaactgtttttccttttgtatgtgcaggttgcaagaattattatatgaatactgacctactctataaaatttaacagctacatatgaccgagatatgctgagctgagattttgcagaagtgacgctttttcaagttttcaaatttagtaaaaattaaattaaaataaataaatctggcgagatatcaaatcacagccgttgattgctagcaaaaaatctgacctctttaaactgtaatagcaaaaaaatctagttaattaggctaattatctattagatcgaactttcacgttgtttcaaatttaaagagttacacagcgtgtcggccacttaaaacgatgtcgtaatgttgtttcccctcctcgacaagcgccaagcccgttaaaatccccaatttggatatatatcttttctctgtcgacgctctctctctctctctctctctctctctctctatcttaactcaactattcagtttcaattttcaaatttcagaaaccattttctctctctatctctcttcttcttctttatctcagtaatggagacttcatcgacgatctcgatcggttcttgtttaaaagagcatcagaagatctacaaggaatggttcaacatcgccgattcaggttcagtgtttttttcccttctcagattgaatttactagtgcgtcttagttattcctgctctgattttgtttcgattctctgagattacagatggagatggtcgtgtttcgggtaacgatgctacaaagttcttcgcgatgtcaaagctttctcgccaggaactcaaacaggttattattcatataatcgacgattcgtgaaatatataggctatttggtttaaaattgaactttctgagttcatgaatccatggaatttgtaacagtgtaatctagggttgattggaattagttggattttggtttgtaggtttgggcagttgcggattcaaagcggcaaggatttctcggtttatcggagttcatcactgcgatgaaggtataataattgtatcaattacatctgttaatttgaaattttctgctaaatttcttactcaatggattgattttgttgctcagctcgtctcattggcacaagaaggacatgaaattacttcagaccttctcaaaggctcaagtaagtggaaaattacatcttaaactgtttgaatcaagaggttctgatgtaagagcttgatagtcatattagatatagctaatctgtatctttgtttttgttatagttgacatgaagagtgtggaacttccagtgttggaaggactagaaaacgttgtatcagtaagactctttcttatctgattatctcattttgtttttcaatctttacatgatttggttttcctaatctaatatatttgcttacagaagcagaaagtgtcaaaaacaaatgtggatgttgaagacaatggttaaataacattctttattttcaccaattgtttcattcatgatgatatttttcgttaatgtaaaactgttgatttgctggatgaacttttgcagtagttaccaagccacaagtcacggcaaaaactccttggttcaaatcaaaatctattattaaggttggttgctgttttctttattgctgcaaatgtgattctttttcaaatatggagtcatgtgatttaacgagtattttgtcacttttcatatccagccacaagtaaatgtggtgacaattgttgatggcttgaaaagattgtacactgaaaagctaaagcctttggaagtcacatatcggttcaatgattttgcatccccggtactggtgagtaatatccttactgtttcagaaacacttgtgagtttttgtttattccgttttttcggtgaagagctaaagaactcatatctatatcaccatggaaaatgattctcagtttattgatactttatgatttgcagactagtagcgattttgatgccaaaccaatggtaatgcttttgggtcaatattccaccggaaaaacaacatttataaaacacttgctcggatgtgactacccaggtaacttgctttgtttcctctaatcctagcaaatgcaaggaatcttcagttatctatctgatcttcaccattgtcctcttgttgtcaggagctcatatcggtccagagccaacaacagataggtttgtagttgcaatggtatgtcaatgtgtcttgatctaattgtagtgtaatgattgctagttactttttctttttatttgagttaactcttatgatttgattttcttatagagtggaccagatgagcggactatacctggaaataccatggctgttcaagctgacatgccatttaacggactaacaagctttggaggtgctttcctctcaaagttcgagtgttctcaaatgccgcatccggtgagtgattaagcattaccccactctctctttttatctttccctctgttggtttaaagaagctttcccttcttgtttgtggtaggtcttggaccaaattactcttgtagacactcctggagttctttcaggagagaaacaaaggatgcaaaggagctatgacttcactggtgtcatctcatggtttgcatctaaatgcgacatgattctcctgctctttgatccccacaagcttgacatcagtgatgaattcaaacgtgtgataacatctctacgtggtaatgaagacaagatccgtgttgtcttaaacaaagctgaccaagttgatactcaacaagtaagtttcgttttcgtcccattcatttgttatgttcataagcttcatttttactcattgttgagccgctttttctaaagctaatgagagtgtatggagcattgatgtggtcgcttggtaaagtcctgaacacaccagaggtcgtacgtgtctatattgggtatgttttttcgagtacaacatgaattgtcaacaaagaagtcaaaaagccattagtttcacttgtacacacgatagattgatttctttttctttgcttttaacttgtgcaggtccttcaatgacaaacccataaacgaagttgcagttggaccgattgggaaagaactctttgagaaagagcaaaatgatcttctagcagacttaatggacgtacccaagaaagcatgtgacagaaaggtatgattttgatgagtctcaatttaaacaataatgtatgttacaattctcaaatcctgactattttttttgttattctttgcagattaatgagtttgtgaagcgagctcgatctgcaaagataaatgcatacataatgagtcaccttaagaaggaaatgccagcaatgatgggcaaatccaaagctcagcaacgtctcatggacaatctcgaagaagaatttggaaaggtgcgtaaaatatctcatttggtctagaacttagactaatcgcattaggtgtagcgttaaaatttttgcaattacttagaaatcttttggtagaaaaccaaaccccatccgattaggaaactggaactagaattgatttcttcatgtcctaaaccaaagtactgtatctgactataagccaaaccagaatttagattaggcatacctctctagtgaccaagaaagaagtacaataaagattatagacattttatctcgtattttttacacaaccttatgtcaaaaaaacaggtgcagcgagagtttcatcttccagctggagactttccaagtgtggaacattttagagaagtattgggaggctataacattgacaaattcgagaaactgaagcctaagatgattcaagcagtagatgatatgctgggatacgacattccagatctcttgaagaaattcagaaatccttatgataattaaataataatgctcggtactttaaaaaacattatatcaagtttcagagtttttctgtaatcagtagaatttgtcaaatattttgatttatgttatgtgttcttctgaatgtttaaattgttcaaatcactaaatgttaacaaattcattttgaaattaaacacttcgaaacgccataaaaaaaaaaagaattatacatcaaaatcaatagcagtctatgtaatcattcctctggtaatgctgaactaactctgcagtaaactccgccgacaagaaactcgtcttcatagttcttccttgaggttcattgagatacattcggtcatctaagttcattgagcatttcctcttgagcttcttctctccttatctttctttgttctatatacgatataattgcatgttcacgtttgactacattcatatgagtctcaagtgcttcagaaacttctcgcttatattgaagatcaagactccgttcaacttctctacggttttcgcggtacttctcaaccagagctattgcagagagtgccctttcaatctcattccttatttccttttcaacaactgatacttgattttgaatatcttccgtgcttttggtttggtggtcgttctcagccagggctggccctgagcacagccaattgaaacaattgctttggcccccataaattttgttgcaaaatttggcccccaaaatatattattcttgcaaaaataggccaaattttcctaaaatcttaaaattttagtatcaatatcaaatatttatatataaaacaccaaaataaaaaattgctatggtccattaattctcggagctggccctgttctcggccaaacccattttattcattatcgtatactcaagttcatgatcaaactcatcatcatcgcttaagtatagatcatcacaggtacagatttgactttcttctttgtcttgttgatcattattctctacatcttcatcactatccatatcatcttctgatacacgcattacgaatgctatatccgtccttgaggttgtcttagtgaatggttgatgaaactttgtaaaagcattgagcttcttttcaaaagactcggtctcagagaccaagcgatcgaaactcctgttaggttcagggtcatagctaaacccttcgacgcttttgggacaatcatgttccgaaacaattctcattattaggtctctctctttagttgttttggttctctttgttgttgtgattaatttcttaacataagagctctctatttataaagtttgtgatttcacacaaaaatagtaaattgatttattattgtaaaaatttccatttttttattttttggaacaaaattccattttttcttgtttatttttgcttcgaattcttttgttatctcgatttcttttttttttttcctttttaatttcttttttgtttgttatactcttttttacataagtgatacgaagtgtttcttatccgctttgcatatacgctatggaaaattaaagataaagagaaacttgtgaatttttcattgtcactgtgtaattcctccaaataagctgaaaacgtccaccatttggtcgaaataaacacaattttcaccaggtttgttatactctttatcccattttcttttttttcaaattatttgatttttgtttttattatacaaaaggaaatatattcaacaaaggaaaatttgcaagaataactaacaaaagtttataaattaagaaagtaacagctatattctatattatatataataatgacatatttatccttctctctccacctcactcaaagtcccttcctctctcatctttgtgtcatctctttttctttcttctctcaatctcctctctctttttttttttctctttcttttgcattttctttgtatgtccacgtcacctcacttccctttcttcttagaatcttcacccatctcgtttttttcctaatgattgaaaaattgtaatggcttcaagtctgcattcatcactttcttctaatggcttcaagtctgcattcgttataacataacaaacaaatgagaaggacaaagtaaatttttcagataccacttatgttattcggttgcttgggttgccaatgttgtattttagggtatagtttttttatacatccaaaatagtatagtataacattttatttctctacatccaaaatagtacaacatgtttttacttataaacactatttactattttataaattcaaatccgattttaaaaattcaaactattttatatgtaaaaaagatatacattttttctaacaaattttataattggaatctattttttggaaaagatatatagcaaaaaaaacaaataggtaaaaactaaactgaggtcttgaatgtttcgagcgttccaaaaaaccgcctactgtgttttacttttggtcaccattcacaacgacattttgtcattttattttttaattaaaagaacagaaaaagaaaatacaccatgtgaggaacaaaaacagacccatccatatggaaacgtacttcaaaaatagaatataaggaaaaagtgttcaaaaatagaatataaggaaaagatgtgtttagacacggtagatagttgatattaatatttcattattttttaattaaaaagactataaacactatcctatataacaccttattcactatactattgctattcacatcatacactattttcctttacgttcaaaatactctcttatcatcttacaaaaaaaaacactcatctatcaagtacgcattcaccgatccatctctttgtacaaggttcttctctatcaaatacgcattcaccgatccatctctttgcatcagtaaacttcttttttaatacatatatatatatatatagatatatatgttttattacataaaaattattatacacttctatttaaaataaattaaaaataaaaataaaattttctccacatccaaatattgaaaccaatttacatttttaatcttaacatatatgacagaaactttaagtaaataatatgtataataatagtcttcttaaacatttatataataaataccgtaacaatgaaaaacctgataatatgaataatctgatgataaattattttaagtttaatattatattgtattgtgttgttaaatgtaggtatgtcgtctagaggccgattcaatacaaattcttccaggcaaagaaacacaaatgttcccaccgaaaagatagcaagggtaaatcttgttattatatactttttatatatttgcatattaagtatagtttttgaaagtatattaaactaattctacaaattttttaaaaagttgtagacaacatcgaagcataaatggacttatgaagaagaaaaaacattgattgagttgtttgatcatgcaatttccatgaataattatactcttaaagatcctacgcctctcggtcgagaatacatggttgagaaatttaacctagcatttaacatgaatataaattatttgtttttcaaaaacaaacttgatgagttcaaaaaagcatataaaagatggaaatttctaatgacttctaccggtgtctcggttgattctgaaacatccatgatttctgcatctgactcgtggtggaagggtcatgaattggtaattacttataaccattctattcttactactaatattaacacatacatatattataataaataatatgtatgagttttacagggatgcaaaataactactaagttcaaacgataaccagcagagttttgggatgtaatgcaacgatgttttagattgcatgatgtttcttcccaatcacaacattcttcacgacaaagacaagaagagctaatgaaccagagacgagctgatgatgccattcatggttactcggatggtggtgacatgcctgagaccaatgttcccgagatcgaagaaaatgaaaaaaattatcgtattaacatcgatgatgatacacatccttcgaatgagttcactcgtgacacattccgtgttcctgttggaagaggtgaacaacaaagcagactgaattttaattctagtgtaaggcgcggaagtggttctcaaagatctgaaggaagttcaaaagcaaaaaattttggaagtaggtccagaggaaactgtggaagacaatcttttgaaacaactatacaagacaccatcgctggctatactgagtatcaacgacaaagtttgcaacaacttcggcctggtagttttgatcaagaagattacgatgaattcaaaaaagcataagctatattccttgccttggaacttccaaggaataccaaatttcattgggcatgcattgatacatttaaacagctaaaattttggcgaaagtatttccttgacatagttggaggcactaacgaggaaaaaatacaattgttagaagccatgactagtgtttctcggaacaaccaagacttgtcgaagaggttgggctctggacattcttatggcagtccaaattcaggaggcccaagttttcagcaatgggaaacaccaccaaatgtttcacaatggggaacaccaccaagtactcaacaatgggaaacaccacctagtatacaacaatggggcacaccaccaaatgctaaacattgagaaacatcaccaaatacttaacgtttgggaacaccaccaaatgctcaacaatgggggacacaagcaaatgcttcccaatggaacacaccaccgaacaatcaacattgggggacacaatcaagcgcttcccaatggaacacaccaccaaacaatcaacattgggggacacaatcaaatgctccccaatggaatactccaccaaatgctcaacactggggcacacaagcaaatgattccactggggtacatcaccaaatgttccacaatggggcacccaaccaacagcttcacaatggagttcaccacgaaatgatccacaatggaattcatcaccaaatgcttcacattggggtcttttaccaaactttcaatcttggggttcaccatcaaatgttcaacaagggcgtaatacaccaaattttcaataaggaagctcatctgcaacaactccaacaaatatttagtaatggttttcagtgggaagtcaagaagataatataagggatattcatcaagaaagattggaaagacctagacgaggaggtctgtttaatatatggggaacctcgaagagagtaaatgcaagtacaaacgaggataatcaaattgatttagaagacgaaaattaattttttctatagattattattctcgtttatgttaaaaatattcggcttttcttagtttctatgcatttggtgtaattgtataatgtaagttcacttatggctaaaaacatttttactattttataaaatttcaggttttccgtatatgtcagttgcgatcacaaggaatccatattctaacttataaagaaagacttgaattgtggaaattagaaaatgagcaatttaaggagttaataatccagccaactttgagttactatgatcgatattttcaaagagcaccagcgcaaaccgatggaggtttaggatggagaaatatttggcatcgactacaacaagatgatgctgcttgtcttcagttattacgaatgtcactcacagcatttacaacattgtgcagtctgctacaaacaaattacggtctacaaccaacactaaatataagcattgaggaatgtgtggctatgtttttacgaatatgtgggcataatgaagttcaaagagatgttggtttgagatttgggcgaaatcaagagaccgtgaagagaaaatttggagaagttcttacggcaactgaattactagcatgtgattatattagaactccaaaaactcaagatctacatcgaaatcttgagatacttcaagtagatcgaagaaattgaccatattttagtggatttgttggagctatggatgggacttatgtttgtgtaaaaaagtgaagcctgaattacaaggaatatattggaatcgacacgataatgcatctttgaacatcatggcaatatgtgatttgaatatgttcttcacatatatttggaatggagcaccgagatcatgtcacgacaaatctgttctaacaatggcacaacgaagtgattctgattttcccttgcctccgctagaaaagtactacgtcgttgattctggctatccaaacggacatgaatttttggctccttacagatcatcaagaggtggaattgtgaggtatcatatgtcgcagttctattctggaccacctccaagaaataaaaaagaattatttaatcgatgtcatgtgtcattacgttcagtaatcgagagaacttttggagtttggaagaagaaatggataattctttgtgatttcccaagatatagtattcaagtacaaaagagaatggtaatgactacaatgggattacacaattttttcaaaatttcaaattttttagaagtaatgacagaggctagaattaacaatacagattgggagcctgaaataaatgatatggaagcaaatgaagtagcagatggagaatttatgacacaaataagagacaatattgcagatatgttgtgggcaaataaaaatactcgttaatattattttgcttgtgtttttgataattattgtttcccttaatttctgaaataaatttatttttataaaattctaaactcaaatatttaaattaacgtatatttaaggtttgtaataaaatataaaattttttggtaatttaacacaaaactataacttttataataataatatcactaatctatttttattttcaaaatatataattataatatatttgtaacgcctattgcgattttaaccattcactcatttgtaatgtaacacatatcgtttttttaccattcatacattgtcccgcactgtctgttccgcactaactgcactcgttccgcatactgcgttttaatcaaccggcccgcagtaaaaccgcaccgcacttctataaccgcttgtctcgcactctctaaaacgcagttaccattcgaagcctaactgttactaaatcatctcacatacaactcaacactaaaatcgtcttcttcttatctctacatgctatttttttaatttatatatatatataatgttatattcttaattacattataaaaatagctagttttgcaaatcaccattcaacaaattcataggattattgaatcattattctttgttcaacttttttgtttttggtaaataatattattgtgtcactatagttagaaatagaaagggaaatttgcagatctaacacacaaaaaaattataattaagaaagtagcatcaaaacaaaaaagagatgatattctttatattttgtgtattaatcacaattttgcccccttcctctttctttctctttccctctctctctcttccctctctctctctttctctctctccctcccttcctctctctttctctctttctctccccctctctccctctctctctttctctctctccctttctctctctctttatctctctctcttaatgtctcttacttctatttttttctatatgtactttctattctattctaacaaaaaaaaatagtacacataataaaattcataatacaattatcacctatattattacaccattacctctactaccaagtcaccattatccttatcagtggctcactgctataaccgtattgtcgtcactacaatcgtattgccgtcactacaacagttaacttgcttgattgggttcccaatattgtatctcttagggtatagttttttaatggggatcatatcgctttaactcagtaatttaaatcgtctatgttttatcttttacgattatcgtagctaatattgcaacctaaactactatcccaccaccactaccaccactattactttatttaatttaaaatattttgttttatactaaaactaaaactgaattacgaatgatttatgaaaatagtatagtacaacattctatttctatacatcataaatagtacaatataaatttacttacaaacattttttactattttataaatacaaatctgattttaaaaattcaaactatgttgtatgtagaaaaaaacagaaatttttatctaataaattttataattagaatctattttttggaaaaaatatataacaaaaacatacaaataggtgaaaactaaatgaagtgttactaaatcatctctcatcaactattccacaccaaaattgtctttttccaacccttatatgctattttcttaatttatatgtatatgatgttatattcttaattaagttatcaaatatggctagttttgcaattgacccaaatagaaatcctctctggatttgtctctccaaacgttaccacaatattacttttttggaataacctcaaacgcctttcttttctaaactcttcaaacgcaactcacattatttaaacgcttcaaacgcaactcactttcatcgcttagagagaaagaagaacaaacaaaacaatcattggaagaagcaaaagaaaaaaaaaagattgaaatggagaagaagctaccgagaagattggaaggcaaagtcgcgattgtgacggcttcgacgcaagggattggtttcggaatcactgagcgtttcggtctcgaaggcgcttccgtcgtcgtctcttcccgcaaacaggtttcaccatctctcactttcatcttccgaatttgaattaaaacgatgaaactaaagaatcgttttctagtgatgggatctttgtatttgtgcttcattaggtttcttttcgtaccgcgaattgttgataattctggatttgatttgttacagatgcaattatacaacaatcactgtgaagtgtatgatcgcaattttcaaagattttaaaggaactttgctctttctgtttttttgtcgaccgatattaattagattaagctcaaaagagtcattcctaaggaattgaactttactcttattttcgtagatttgttcctctttgttcttgaattgtagttttgcaatttttcttagactaaaagggttgaatttgattatatatgtgcaggcaaatgttgatgaggcagtagcaaaactcaaatccaaagggattgatgcatatggaatcgtctgtcatgtttccaatgctcaacatcgccgcaatcttgtcgaaaagacggttcaggtaacacatcctacgagcttttggttcaaagctcattgaaaaatttgatcatgaacagctttacataaccaagaagtttgtttttttattgttgttgatttgttgtgtgctttaagctcttactatctcacatttgcgcatctttgatttttacttaagagatgtcttctgtgtttttggattcagaaatatgggaagatagatatcgttgtctgtaacgctgctgccaatccatctacagacccaatcttgtctagcaaagaagctgttcttgacaagctttgggaaatcaatgtcaaatcctctatacttctcctgcaggtaaagcttccgtaagtgttagctttttgtttccatgacccgatagatcaattttttcttagatttgatttgactcctctatgtttattttatcaggatatggctcctcaccttgagaagggttcttctgttatcttcataacttctattgctggattttcaccacaaggagctatggctatgtatggtgtcactaaaactgctcttctcggactaactaaggtatgtgtatcattgtccccatctcatgattgaatagttatgatgatgatggttatgagattatttatcatgtgtttcaggcgcttgctgctgagatggcccccgatacacgtgtgaacgcagttgcacccggttttgtgcccacacactttgcttctttcatcaccggtagctctgaagtggtaatgttataagattgaaactgttaaaactgaggttatgattgtatctcaagtgatggaatgataataattgaaccacttgtgaatatactcagagggaaggtattgaagagaagactctgcttaacaggttgggaacaacgggagacatggctgctgcggctgctttcttagcatcagatgattcttcttacatcactggagaaactttggttgtcgctggaggaatgccttcaagactctaaacaatttcacatcaataatagcgtaaagaatgcaatcagggtatcaagtaagtagagatgttttttttagagttttcaactaaacaagactttaagaaacgaaagatgttccaataatatcacgaggccattggatacttgttggtcttgtaaaagataatttcttcatcagaaagactcgtttgggtttaattcagtggtagaacaataaagtttgggtttcgcatgtatgtgtatatgtaacaactagggttttattgtttgtgtaggtttacttctgtgtttatgttttttgtgtttactacttttttcctcctaagccgctgactagctttcgacaaagtcacgcaagagttgaaatgcatctatcaagtgagcattgatcttgccacataaaagatacattagttacttgtttagcaagaaagagagatacactaatagttccatactatcctctatccatagatatcgaagtcacaaaaagagaaataaaaaccattcatagatacattggtaaaagaggagctaccgagcatttattctttctttcctgattgaaagagatcgaaaactcgaatacacatcagacatgtcgaccttgtgcttgggaagagcattgttcatggcatctctcaaatttttatcatcaacagcatcatagaaacatccacgtctcttcgagtcccttacaagctttttcaaatcgaaccactcagcgacaaagttctctcgttcccaatcacccataaacagtgccttgcacgagtcagtgcaacgttggctctttgacggttagagaggaaccctatgtttccgttacagttgcttctaacggtggatatgataatgatgtcttcttctcctccttgaaacccatccaccgaccggacattcaaagtgaaaaggttatctgatacggaggtgtacttatctccgattctctcttggattgcactaacttgagctttataaggtgaaataacaccaacactcatcttcgtctttgtctcacttgacactgtttaaaaaaataggcaaattaaaaagaaccataagaaacagattacatatatatacaagatcaacaaatatttacctttgagaagattggttaagatctcagaaactactgcaatctcaaccatattcttaggactatgtccatcaccaaactcttctttcccaagtcctacattgatgaacgaaaaagagccaaacatgtttccttgaagaaacctcttttgataggtgctttctttaacaatctcagcatcagagatcttcccaccataaaactccatgttggggaaaagacttatagagggatgcatacggtattgaacattaagcaaatgtttcttatggccaagtgaatccaatctctcaaacaagcttctcacaaatttggccttctcacatacctactcattcaagactatgtttcaaacgcaattcctagtttcttatagtataagacaaaagaaagtacctcgctttgcaccattgctggtagctgaagctcatctcctataagaacagcatggtgcaaaccctgaagttgcaatgcagcaactgattcacattctttaagttgagccgcctcgtcaactacaagcatgtctatggaccctgcccgttccgcggtcatttctgcagcacccgaggcagtgcaaaagattatgtgtgcattttgtaggcagaatgtccttatatcctccttcatcaacaaggctggaatctcaaaacgttttgatagcaaacgtagagtccgaaggcaatcaacacagacaaatttgttgaagcaatcaaatgtgaagcttccttgtttctcctgcaagaaagttctggcttggcgaagagcttgacgggctacgatcatattcttcacatcgttagacgatagaaaggacttaggcagatgtgtatacaaatccaccatatccttctggatcttcttcattgtttcacttaacccatcaaatttttccattacaaactccccaaatgtaagaatgatttcttcttccttctccggtgtttctttcgagccaagaaacattttcattacaaactctccaaatgctgtcagaatgtttttagtttcttgattctccttcctttcacttagcaacagatatttcttataactagattcagcattttcaagaatatctatgactgcctccaaactccgttcccattcattcgatggcgaaaacagttcacccaatttactaatgcgatcatcaagaaacacgttgaggagatcatcattccccctttcgtctatccccattcggactcggtttccgactaaaacaatattgccaagtccgtaagtagaatgttctgttgaagaagattccttaaatagcgccaagagccttgatgcaactgctactacagccgtgtttgtaggagtgcacacaactgttttgcaacttaggctgagaagagcaaacagaagagtagcgactgtctttgtgttaccggtaccagggggtccccatatcagtttcacactagtcttgtcgcggatttctcttgtctcaaggcaagccaaaattgcagattcttgagaagagttcaaattcgctgatcgtataatatctaacacatgattcccccaattcctagaagaaacagattgctctgtatcctgaaatatttacaagaaaaaccacagttactccacattagacgctaaagccagatcatttcatgtttacttaccgcggtatttgcttgaaggacactcttgatgagactcaagtttccatctccgttgtgcaaagccttccagatacgagtgtttgtggttaagtatataagaaaaaaacccgaacgaaacgaatattgctcatcaatggatatagatttagaggaatgaacagagaaatgtagctcatctccaacagagaacacatacgcaagaatcagtgggtttaagtcatccacgtttccttgtgactccaatgagatctccatgtttcggctcgtagttagttctatttccttgtgcaacactcgtaagtactgatatattaaccttgtttgagcttctactcggtaattttattgccgtagcctccacggaacttatgtaaaagacaggagctttccacaaacagttcaagcttgaggacaactctgtacgtgtttcctctagtagaagaggaacaaagctcttacggtattcatcaacggaacaaaacatgcctggtatcgagtatcgacctaatctcttccttgttgatatctttgttgagaatatagttgagagaagatttgattaatcagacttgtcttctcatttctctccatgtcacagaaactttctgcaacataataacaatgaaaaacttgagttaggttcctaccttatagcaggtcatagctacatagagaagtaacttggcttacaacgcaaactaaataggaagatgataagtaggaaacagtttcttcaaaagcactgatgcaaaggaatcaacaaagccacaaacgaagacaacaggaaaaagctggcttatcagtttggtctacttataaagaaggaagaggaagaggaaaggtccaaatagaataagtaatttcttcaacttccaagaataaattgtgaatatatattagacagacatataaagtgaaaatagcacattgcttgcataaactagaatttaagtcaatatttctttttatttttgaaaactgtcattagtacttttttgtttgttttacgagaaattagttcactaagaagaaatgtcagaaacttaagaacgaagcatttacggtggagaggacaccatttgtctgctatgagtcgtcataatcatcatcatgattatacgaaattagtcacatccgtaagattatattataatttgtaaaaaagtactttaaaataccacacatacaaattttatccaaaactaataaaacatttctttcgtttataaaaaactgattcaaaaagtagtaaaatggagcaaaagaatttaaatagaataataaaaatttacacttgaagatttcacataactccgttgtaaaagacaaaaaaatcgatatggttgactatacattatacaatcgctttatagaaattagaatgggcagcaggtcaagaacaaattgacaaaatgagatatcgttttcacgttttaataattatgttaaaatttagagattttgttatgatgaaacattttataaatttttaagctcattttgagcattttagagggaataagcatttttttttttgaaagttttctacttttttaaaggtacttttttaatttatttcctaatgacgtcagctgttgcgctaatatggttaacaaattttaatcacagctgttcgtttgttttggagaaagaatcaatttggtggctattattaagagttagagaagagttggttgttgtgtggatagaaccgacaatctcgtttttttttgctctccagaaggaaacatgagcgaggaggtaaaatctaaaaatttattgcggttattaaatctgttgatggttgtggattcgtgttgatggttgtgaaatgttattgtatgtaggttccaatagagagttattgtatggtcatctgcggggaatgggaatgctcggatattcaagaatggtattttgaaattaacaaaattctaatgtctagaattgttccaattcctgcagggatgaatctttctagtttggaagatattgttttgaaagaattcatgaataaagattttacatttggaacccctaggtttagttatttgccgtctaatatcatggattacacgacagggaagaagacacctccgatattgattactagggaggtaggtttgaagttcttcattgagatgtttgggaggaacaagggtttaaatttgtttgttaccttcagcgaaatgattgaaataggaaattctcgtcggaaaaatgttagagaagaagaagttgctggttcatctgtaatgaagagtaagaaaagagcaatttcatcatcatgtgaaggacttgcaagaagtgatgatgacattggatgggaagcaccaactgctggttccaaaatcccaaagattccgacaactcaggatgatgacgctgttatagcggaagttgaagtactagaaaccatgtataacagaggcgatgaacatttacatagcagtggcagcgagaggaaaagtagaactagtgccagtagtgatgaatatgaagatttatttgggaatagtgaggaagaggtcgaagatggagaaaatgtagatgaagttgctccgacaggttatgatacagaattttggggtcactttttggatgatgagttagctggttctaatgcacctgagatcatgtttagtccacgagtggctagaattcaagaagataaagattgcaatgatggtagaggtagtagtactgactccgaatccatgccaaatggaggacagagaaattgagaaacaaggaaacttgatgatattgaagatgaggagtttaatattcctccgctttttgatgatactgagtatgaaagagacgaaatcccagaacttgatattgaagatgatgagaaaggtatctacaaaggaagggtatatgcaagtaaacaagattgccaaataagcttagctatccacgctatcaaggagcaattttactttaagcagtctcgtaccaagcgacattactttgtgatcacttgtgctgatgaaaactgtcagtggagaataatgtcccatgagatgaagacgtgtggttactacctgataaggaaggctgatttagagcacacatgcaacattgaaacaaggggacagtacatgaagatggcgacttcaagagttatagcatcagtctataaagccaagttcagtaagttctctgaagggcctgtacctttggatttgcaacaaatggtacttgaggatttgagagtgacaacatcgtatgggacgtgttggagagcaaaagagaaggctgtggaagaggtttttggtactgatgatgactcatacaagtccctagaagcgtatttgtatgttttaaaacttgcaaatcctggtacagttacacatatcaaaacagagactcaagaaaatggatttcgcaggttcttgtatttatttttggcatttggtgcatctattgatgggtttcgatatcttcgtagggttattgtagctgatggtacacatttgactggtaaatacaaaggagtgttattgacagccactggacaagaagttaaactaggggaatagaagttatcaataattgaaacgtcgattcagtgaaaaggtttttcaatcagtgtttaaacggaaacatcttctcttatacaaaatatattgccctagaacaaatcgcatcaaaaactctcttgatccaattatgtatttccaggtgtttcttatggctaactaccatatgcttcacgagttgtcacctgttcttatggggtggagaatatgtgtttgtatactaaggacacacaaaaagttagtgtatcctaactcctatgaaatttgctgtattcttgttgatgagacggtaattttgtaaatccttatatttataaaataattttttgacttcttcaatggaaaatatctatttgggttttgtttttattagggtgatcaaatggaagcaacaattgatcgtcggtacgctgctgtatatctggagtcgatggaggaaaaacagtggaaaagaataacgactttcattgtcagaaagatcatttcaccgattcggtctacatccaatccatatggaatatggtttaaaatcatagtatacatatacataaaccgctaatcggaaaacgtgtatacggtagaatttagtaatcggtcatataaatcaaaagttaataaaaacaatatccataacaacatatccagagtaagacacaaatattatctctttaattcacaagtgtttgtaaatagtaaaagctatatagtcaaatcaatagaaatagatccataaacctagactctaagccatatacaataaaccctaagcactaaaccctaaaccataaacactatacagtaaaccctaaaccctaaaccctaaacactataccctaaatccctaactctaaacactaaacactaaactctaaattctatataataaaaactatactcaacaccctaaacactaaaccctaaatccaaaatcataaacataatcttaatctgtgttagatagttgtgaatgacatattataattaaattcgttatatcaaaaacaatttcatggtatttatagtctgaattaatcataaatttatatgtaaattttaaaatcatagtatacatatacataaaccgctaatcggaaaacgtttatttgttctagggcaatatattctgtataagagaagatgtttccgtttaaacactgattgaaaaaccttttcactgaatcgacgtttcaattattgataacttctattcccctagttagcctaagtttgagagggaaatttgccgccaaaacaatagatcatcaagtggtgggaattctgaaaaaatataaatccacgtatagcctaataagtagcaatgttcatatggaagtattttaaggttctgacgcagtctggatattggcaacatataccaaggttatgaaaagtgaaggtaacatcattgtcttatctcattaatgaagttgaattaaaaaataataattaaaaaatttatattattttacaaatccacactgacatatccatgtgtctaaaatgtatataattaaaaaaaaaaattataaacctaagcgaaaaatttgccatctatccgaaattaggttaagaataggatattggtttaatgaataaacactatatatctcttatataaaccgtaccataaacttaggctaactttaacaatttctcttttaatgggagactcacaagagagcataacaatgtgtggtgtagaagaaagttgtggagaaagcaagggttcaaatgttgttatggaggtattttaaaccgtttatatgaatctagtgataagatgattttttaactattaacttacttttaattttgaaggtgatttcaatgtcagaatttcacattcctcagccgttgatggagatcatcgtaagcaaggttggtgaagatggtgttgatgcgttgaagaacttcttgctgactgggagagaggggagagttgcggttttttctaagaaaacattagcatccgtacgaattgacaaaaaccatcatttcatgtggtggtccatgcctcattcaaaatactacactttcttcaagaagtgtcttgtcgcgaataatccttatgcgaagtttgtagagaatcataaagggctggcttatgaatcgactatagggtactttcaaatgagatgccgttgaaaggtgtgcaatggtaaacgcaatggtggtttcctcgacttgaatgaaataaaagtgtgcatggttcagccaccttatcagccggacagagttggtaggccaaggtaccgtagatgtaagaagattgggcacatgttgagcacttgtacggagtaagggtttgaggatgaagtcagaatgttggggaattgttcttgaatgttttttttggattgctactaatgtaagtcgggtgagaattttaagcttctttgatggtatctttgtctcatttaggtatcagtttgctatcttgtttatgttattaactttttgaatccatgggagtttatccatatgatcttggatttgtaatgcaacatttataaatatttttagaattatgttaagaaatttggctaagaaattttcctgaggtttgaaatatcaacattattgtatgtttgcctgaggtttgaaattagcatattaccctaaattgaaggtttaacaatatcatatgataattagctaaaaggtttgaaccgattagatttccttaggtaattagctaaacggtttgaaccgattagattctcttaggtaattagctaaaaggtttgaaaccgattagatgttctttaaatatttatttgactaaattggatacgtctgtgtggatacgtctatttggatatcgataattgtttatgaataaacgtggactttttctattgaaccctatatatttacttagatagaattttatgctataaacatccttacaaccagaatattacaattattagtattagtcaataaactttttagatttttaaatattttcgatatcactaaaatgcataatctacaatataaatcataatttatacgtcatatagagagaatatgcgataaggatattgaaaccaccgcctaaccacatggagttaaaccgaattgttggaaattttttaaaataagatcatgatgaattttgaggaaaaaataattagatatatatatatatataggaccttcatagcctatagcgttagagacgtgtgtaagttgttattgagaatcgttccatgtagccgcctacaccatctaatgacatatcaatcaatcaactgttgaaacggctaatttaaaattatttcccacaaaacacattaaccaatgtaagctcaattgttatttgacatatgctgtttaacctttacaattaaaaatttgtatattttgtagttttataccaattgatatcaattttaaacagatgacattcgacggaacctaccctatctatataatataggtaaccatgtggttgtgattatgtaattatattgtagaatagtcttagaaacttaggtaaacttagttaaaatagagtaaagctgagtttaaggaggatcattagttcgtacaacaaagaacattacaacaaagagttcagcaagggatttaaacaagggtcttttaaaacaacaacaaaacataaatccgataaaaagtcttcactaggagcaaaagaagacatagtgaacctttagtattcatacatcaggcgaccaactgcaaaactaatagatacaatatagagaagtcattaataagagttcatataacccagaattatctcattatagaaacacctagaactagaaactggactttccaattcgcagttatctagaaaatcaattttttacaataagtcttgacacccatgatttcattaaaattttcactataattctttccctatcttcaagcaaactcctgtttgagacctaacagaagagacatctcgcaagctcagcaactcaattcagtttaaaattttcccttaaattcatattcaaggcttgcagatagcgctgggagttcggtggaaaccgatcaaaccgacccgatcaaaccgagattttcggttatcggcataaaccaaactgattcttcttatccgataggcgaaattaatttgggaaatcggatttcggttcgggtcggttcggtaatcgaaaccgatcggttttacctaaaccaaatatctacagccatttataaagctaatgagtcagttgccctaattttgtctcattttcttcttttggatcgacgcctcctcttgcaaaagggaaatagagaatcatcttcttctctaacttaatccataattttgctaactttcttttctttcatcaattcatcatcttctacatgttcttttagtctttaaaatctcaattgttgttagctcttctttcttcttaatcgtttctttgtctgattctttgttgtttgtttggtaaacttttccttatgacaaaaatcacggctagggtcactggtaactctctagatctgattgatcttcaatttacatcatagatttgtatgttattatcattacatatatgatagatcttgtcggtcttaacttttttgcggttggggagatcgtccatcgccgtccactgccgccgtcgtcaccgtccattgccgccgtcgtcatcgtccgtcgctgcctcatcaccatcaaccctaattgtgaatgggctggggcgctgggctttgtaaatttgctaattgggtttgtaaaattattattatttttggtgatataaaaagtttgggcttaaaacaaagcccattatccttttttctattgtaattcggttcaaataaaccgaaatagtaaaataattgatttaattcgaaattaatttgaaacccaataaccgaaccgaataacccgagtaccgattgacccgaaccgaaattaatttcagtttaattcggagaaatttttctaaaaccgaattttccctaaaccgaataacccgacccgaataacccgatctgaccgaactcccaggcatacttgcagtaatcaaaacacaattatctaacttaaattcttgacagctgataagtgtgttttttgcatgttttgagcatccatttgtcatcactttagcatcatatcatcactgttttataccatttctcatcatttgtcatcactttacatgtttaggatagatttgcatgcatgttgcatatttgcgttgatttcaggtgatttggagatgttgacgagctatctggaagaagcggacctggtcatgtcaaaccactcgaccccgaggtcgagtagtagcttcaagatctcaacagatcactcgacccccaggtcgagtagaggacatcactacttcaccacatcactcgaccccgaggtcgagtgtcttcatcccatcacctgaccatcactcgatcacatcattcgaccacaaggtcgagtgtcttcaccttcattgccagaccactactcgatctcattactctacctggaagtcgagtatcaccatcaccaccactcgactgcatattcgatgacaagcttcagagccttcttcaatccgcactcaaccagacactcgagcacaaggaagaaaagaagactccagctattcactcgacctcctactcgaccacatgggtcgagtacagttcttaatccgtcccaatacttcgtagttttaagtattagggtttcggaatatttggctataagtagcatgtacttcacattttcgcagacaagttttttatctagttttattccgcagaccttgtgttctagaccttttgaaatccggatttctctttatctattcaatattcagtattcagcttttgatcttgatttcatttactgttgttcattttgttatcatcctgctgttacactgttgttatcatgttttcaacttattcaacgtttatgctttctgttatgatgtctgagtagtgaataggtttcggaggatgggttagagtagtgtagaattctcagtatgctaggtgattgagtattgattgatagatccctactggattagttgttcttaatgcctattgctttctgatcaactggaatttgagcccatacatttccgcgcccgaaaggtgttcgataaaatgtctgaaccactaattccagagattcgtgaccctgtaccaaggtattcgtgattcgtaatgcctcttaggttagctcttgtcaatagtgattgagtctgggactaggttaacttgtgagtctctgttgcagtggcacttagatttggttaatgaacttgttgtctagggttaaatttcatttactgttgttcattttgttatcatcctgctgttacactgttgttatcatgttttcaacttgttcaacgtttatgctttctattatgatgtctgagtagtgaataggtttcggaggatgggttagagtagtgtagaattctcagtatgctaggtgattgagtattgattgatagatccctactggattagttgttcttaatgcctattgctttctgatcaactggaatttgagcccatacatttccgcgcccgaaaggtgttcgataaaatgtctgaaccactaattccagagattcgtgaccctgtaccaaggtattcgtgattcgtaatgcctcttaggttagctcttgtcaatagtgattgagtctgggactaggttaacttgagagtctctgttgcagtggcacttagatttggttaatgaacttgttgtctagggttaatttattgagcatgtcaatcacctgtaaacttaggaaacgaaactactcaattaccccatcctcggaaattcattatctaattgaattctttgtttactctactgttgtttactgcatcttgttatctgtcgcttagtttctgcaattctttcttgttactcgacctcatactcgaccacccagttgtctggcaacagactgtgcagtctagtatctgtgttttattttctgtctgttactcgacctgtcactcgacctcacctagtgctctgcaaagagctgtgttggtcgagtgttttactgtttctgtttgattttctgttttctgcatgttcacttaggactgctagaacacaccaaaacctgttattgcttggcttgacttagtgatttctgatcccatcttgattgttagcatcacacccatttggattgacaacctaaaatactacaacgacatgattggtgttttaggataatggactaaaaacctattatcaatttggcgccgttgcaattgggtgtttgtttattacatttgagatttcagacttgcttagatcaagttctttttcaattttcttttcggttactaactgtgtgtttttcttattgtcttcttgatccaggtacacctctgctgtatgcgaactcgatcaacaggcaatcagaacctccttttcaacgacaacatcgaccgcatagctcgcgaactcagagaaaggagaaatacagtcaaccttgtacctcaacaaccactcgcaatggctgaagaacagaatcaacaaaatggccctgccaacattggtgctagagatgcaccacgtgatcaccgtcaaaggaaagaaattgcacctccggctatccagaacaacaacttcgagattaagagtggtctcatctcgatgattcaggggaacaaattccatggtctgccaatggaggatccactcgaccaccttgatgaattcgataggctctgcaacctgacaaagatcaatggtgtcaatgaagacggattcaagctccgtttgttttcattctccttgggcgacaaagcacacatctgggagaaaaatctgccccataactcaatcaccacctgggatgattgtaagaaggtttttctatcaaagttcttctccaatgccagatctgcaagactcagaaatgagatttctggtttctcacaaaatactggtgaaagcctctctgctcagcactctctacagaggagtcctaccacgcatcagaatgcttctggataccgccagcaatggaaatttccagaacaaagatgttgaagaaggctgggaattggttgagaaccttgcccaatcagatggtaattacaacgaggactgcgataggaccgtcagaggcacagctgactctgatgacaaacacaggaaggagatcaaagcgctgaatgacaagctggacaggattcttcttagccagcagaagcatgtgcacttccttgttgatgacgagcagtttcaagtccaagatggggagggtaaccagttggaagaagtcagctacatcaacaacaaccagggtggctacaaaggatacatcaacttcaaaaccaacaaccccaatctctcctaccgaagcaccaacgttgctaatcctcaggatcaggtgtatcttccacagcaacaacaaggtcaaaacaaaccttttgttccctacaaccaaggtttcgttcctaagcagcaattccaggggaactaccagccgccaccaccacctgggtttgcaactcagcaaaaccaaggtcctgctgctcctgatggtgaaatgaaacaaatgctacaatagctgcttcacggccaagcctctggctccatggagatggcaaagaagatatctgagttacataacaagttggactgtagctacaatgatctcaatgtcaaggtggaaacactgaataccaaagtccgatacttagagggacattctgcatcttcctctgctccaaaacaaataagccaatttccaggaaaagcaattcagaacccaaaagaatatgctcacgctatcaccctgcgatagtggaaaaacacttccaactagggaggaaccaaagacagtcactacggacagtgaagatcaagatggggaagatttaagtctcggaaaggatcaagctgacaaaccactcgaccagtcactcgaccagtcactcaagaaaccactcgacctgtcactcgagcaaccactcgatctgccactcgacaacgttaaggaggttgagttgcggatacctcttgttgacgctctagcgctaatcgcagactctcacaagtttctgaaagacttgatcgtggagagaattcaagaagtgcaagggatggtggtattgagtcatgaatgcagtgctatcatacagaagaagatcattcctaagaaacttagtgatcctggttcattcactctaccatgctctttaggtccattggctttcaatagatgcctatgcgatttaggagaatcagtcagtctcatgccgctctctgtcgccaaaagattggggttcactcaatacaagtcctgcaatatatccctcatcctagctgacagatcagtaagaatccctcatggtttgctcgaaaactctcaatcaggatcggtgctgtggagataccaactgactttgtagtcctggagatggatgaagagcccaaggaccctttgattctagggcgacctttcttagccactgcaggagctatgattgatgtcaagaaatggaagattgatctaaaccttggcaaagcctttaggatgacctttgatgttaaagacgcgatgaagaagcctaccataaaagggcaacacttttggatcgaagaaatggatcagttagctgatgaattactggaagagctgggagaagaagatcatcttaacagtgctttaaccaaaagtggtgaagatgggtttctgcatttggaaacattgggataccagaagctgttagactcccataaagcgatggaagaatcagaaccctttgaggaattgaatggaccagcaacgaaggtaatggtaatgagcgaagaagggtcaacacgagttcaacctgcactctcgaggacatactcgaccagccactcgaccttgtctgccaacgaatctgaggagccgatcattccaacttcagatgacttgtcttaactaaaagcaccgaaggttgatctcaaaccacttcctaaaggtctaaggggaatcatgagcaattacagtggcagttcttctgttgatcctgactacaacatggatgagacagagtcgtcatcttcaaggccagaaagagaacagagagaatatgatagcttcagaagaaaggctgatatagctcgagggaagagagcgatgacagagaggtatgagcttatagatgaggatcaggatgacgagtacatgcctaagcatagtcgcagagccaccaaactgctaaacaaacccgatgtattgcctgctgaggaatatattaggttcttcaagctaaacgagttctgtagcacgaggtatccttgctcaaccacacttgcacaactcagattgctggaagatgttcagcacctgtaccagagttatcatctggacactctgatggcttatccgtatgtagcatatgaagatgagacaattcaattcctctccacgctgcaagtggagctctaccaaggtatgacctgtgatgagttggattgtgaaggattgggattcttgcgattctctatatatggtcatgagtataggttatcaatcaagcaattggaaggattgtttggcttccccagtggaacgggaactaagcccaagtatgacagagaagagttgaaagacttgtggatcaccattggcagctctgtaccgctgaattcttccaggtcaaagagcaatcagatacgcagccctatcatcaggtacttccagcgttctaaatgtgctttactcggagagatcacagggactgttactaattctgatatggagatgatcgcaatggctctcaagggaactcttcgccaaactaagaatggcatgtctctccaaggtgaaatcaatgacacacctctctctgtacttcttctgatccatctgtgtggatacaagagcatggccgtcagcaataaccacaagagagcatgaggcgctctgtgcataggaggtgttgtgacaccgattctgatcgcttttggagtcccgatcacttctgatggtatcgagccgcgagcaatggatatcgagcatctaggtcactgcgaattcttggagtttgcaatggttgacgacttgcacaggttcaggtttgagcattctacagacaagagagctagcatccttctccccagccttgaggttacacggataatcgagggagataacattgatttttggcctgaggttggacgcctctactatgagaacgctccgccattggatgaggatgatcttctagaagaagctgcttcggatgggatggatgaagacagaggagtggagttcgacactagcatgtatcactttggtgaacatgtacctccagcgagggagagcaagagcttgactgactgcagaagtggtgcaagaagcaggacaaactgctcgccaagtgtttcaagactatcaagcttctaacagataagctgagttgttcctcctccaccactgctattccacagggacagcctcctctggagatgccatcgaggagatttgatgagcctgagctcaggcctgagcttagcgagcagagagtctcacatgtcccggctaggcattcgtcattcccaggagcacaagagaagaaggaaggctacactcacacaatctagcagcagatcacgcctcattcactcgagaaggtcactcgaccgcgatagaaggagagaggtcgagtatcctcagagcggtgctggccgccatagagctgatggggtcgagtacccacctgctggagctgatacggaacaagggggttcgtctatagcctggtagcaatcagaggctgctattgacgagcaactacgttcattcttcgactgaggtaagcgcctcacttcaccattgtattatatcatctgttgtgatttgtttcttcattttgtttctgtgattggatttgtcctgagtactctcttccaagtttattcgcacagtggactgtgtgatttaagtttgggggagggctcaggaagtgtgtgttgcattgtgtatatttttgagtctacattcatctaaggcatagaaaaacaaaaaaaaatttgaaaaatttcagaaaatgatttcacaaaaaagagtgttcatgtagttgcattacatttaggatcgagtctagagtgtttcatttaggattattgcatatgcataggggatgatgatgagatagccttgtaagcattttgattcaccggataaactcagtgccctcgttgctagttgtctattgcgtagtcaatgaatttgaaatgaaactgaaccatgcctagattgctctactcgaccaaactgtcatgatctgataccattccctatcaatttgaacctgaatctgatctttaattatcatgtctgcatcaaatttgaactcatggataccctaaaatacttggattttcttattcactttgatcactcttgttaatccaagtagttgactctccttattagagcagttaacccaaacctagactttctttcaagccctatatcacttgtgagtgtttgtgaggtcttatttcgattaagcttggtagaaagtgttaggttcgtaacgatagagatagtgtctcatgtagttctagttcgcatgttttggactagataggactaggtgggcgcttatactttgggttgggatgtgttgaaaagaaaaaaagggttgattcattgataagaaaaggtaaaacactctacgtgaagtaagctaaagaagcaggaaaagtctagtaaaggttttgggattggtaaagaaaagaaagagttcttgttagctattgaagatgggcaaaagcccttgattttaaaatattaaaaacaggaaccttagttgttaaagaaatccaaatccgctagatgtatcaaagtgttgagaaagcttctcctagagttaagagaaaagaaaagaatgattagaaaaagggcttaaaagattcatgaatgcaaagggtagagttaagttcttatattgggattggagatgggattaccattagagcttcatttgatgtactctgggtagatgggatcttatctctgtatgcatagcttggaacctacctttagcattctactaaaggttaatcattcttttttagagatcccctgttactgaagcctattctgtaagggaccatctttgtctcttgaccttttaccttagccaaatgagttcattgatgatgcattgcttgattcacattccagaactaatgaatgttaaagggattgatagatttgaaaacttgtgtaggtcgagcatatgagtcggattgattgatgatgaggcatggctaacgtttttaagtagaattcgatcttgcagcttagaactttcaacttggacattgatttcatctagtttatctggtgctttggctctgagtccccgctttcaaacctcacctccagcttgttcttgatggtttgcttgagggcaagcaaagactaagtttgggggagttgataagtgtgtattttgcatgttttaagcatccatttgtcatcactttagcatcatatcatcactgttttataccatttctcatcatttgtcatcactttatatgtttaggatagatttgcatgcatgttgcatatttgcgttgatttcaggtgatttggagctgttgacgagctatctggaagaagcggacctggtcatgtcaaatcactcgaccccgaggtcgagtaggagcttcaagatctcaacagatcactcgacccccaggtcgagtagaggacatcactacttcaccacatcacttgaccccgaggtcgagtgacttcatcccatcacctgaccatcactcgatcacatcactcgaccacgaggtcgagagtcttcaccttcattgccagaccactactcgatctcataactctacctggaagtcgagtatcaccatcaccaccactcgactgcatactcgatgacaagcttcagagccttctttattccgcactcaaccagacactcgagcacaaggaagaaaagaagactccagctattcactcgacctcctactcgaccacatgggtcgagtacagttcttaatccgtcccaatacttcgtcgttttaagtattagggtttcagaatatttggttataagtagcatgtacttcacattttcgcagacaagttttttatctagttttattccgcagaccttgtgttctagaccttttgtaatccggatttctctttatctattcagtattcagtattcagcttttgatcttgatttcatttactgttgttcattttgttatcatcctgctgttacactgttgttatcatgttttcaacttattcaacgtttatgctttctgttatgatgtctgagtagtgaataggtttcggaggatgggttagagtagtgtagaattctcagtatgctaggtgattgagtattgattgatagatcccttctggattagttgttcttaatgcttattgctttctgatcaacttgaatttgagcccagacatttccgcgcccaaaagctgttcgataaaatatctgaaccactaattccagagattcgtgaccctgtaccaaggtattggttgcagggagtgttttggctttaacttgttgattcgtaatgcctgttagggtagctctcgtcaatggtgattgagtctgggactaggttaacttgggagtctttgttacggtggcacttagatttggttaatgaacttgttgtctagggttaatttattgagcatgtcaatcacctgtaaactgaggaaacgaaactactcaattaccctatcctcgggaattctttatctgattgaattctttgtttactctactgttgtttactgcatcttgttatctatcgcttaatttctgcaattctttcttgttactcgacctcatactcgaccacccagttgtctggcaacagactgtgcagtctagtatctgtgttttattttctgtctgttactcgacctgtcactcgacctcacctagtgctctgcaaagagctgtgttggtgtagcgttttactgtttctgtttgattttctgttttctgcatgttcatttaggactgatagaacacaccaaaacctgttattgcttggcttgacttagtgacttctgatcacatcttgattgttagcatcacacccatttggattgacaacctaaaatactacaacgacatgattggtgttttaggataattgactaaaaacctattatcaacagcatcgcatgactttattacatatactaattagttattatcatatgtgatccatacttgtaaatctaagatgtgctcttaccattttgatttcttcaacttcttcaatcgatggttccgggtaaacagatgaaactgcaccatagctcacgattttaaccttgtttttgcgcccaccaaccagttcaggctccctaaccaccctccaccaagccagtgccaaaacaatttttggatggccatagcgccggtaacaggtatcaaattccaatgcctttctcccagtggcctcacagtctagaacctctttgctgtagaaggaaaacatttaacaattttaaacacacgaaattatcatattttattgaattttagccagaaaacttactatctgtccattaatttgaaaggaacgatcatcccctcaacgccgacgtcgggatcaccagaatgagacagaattccaacttcaacaacagcacccacgagatctgtacattcagggtaagtttagatcaatataaggcatatatcgtaactaccctcaaatatgttgtctctaagaattaattgataaaggtaaatggacatagacttaccgactaacaggtcgatatcgaaagtcccctccaatatgttgtcgaaggaagtgaaattgttgaactggatagcgtgttcggatcagccgatgttacaaccgtctcgtcgatcaagtaaatcccatatttagccgtcgtagtcttgactagatcagaattaggtataaccttgaagttagttaacccgatccacttattttcaacttgtcgaagtagaaggaagaaaagcttcggtagattgtaacgtccatcctcatcctctattcagaaactcaaaaattgttagtatcaggaacatgcaaaaaaaaaaaaaaaaaaaagtttattaccgtttcatcagctatgataactcttagttcgaatgaatcgcccctttggaatattttgtactttttcaagacaatgactcgtacagtccagccggtgatgagaggggagagctcgttgagaagatggtagttgaacattttgtttttttcgtttcagtgattttatggtcaattaatgggttaagcaacttccttaaatatcatctcacataaccaataaatcaatcgtttagaataacaaccggctagtaataactacacgaattaaccggatatcgtttaggtatcacgacataatggatcaaaaattatttttaaaacgtgtatccatagtaacaaatccacaaaatttgggttattgccatgcattacatcactatatatgtaaatccatcagatgttaaacgtctgaagatccacgtggataacaacaattttatttggcttgcttaaaatagtcgaatattacatccaaatatttgaaccgggaagatggggaattctcattcggaagcgagggaaaattgccgccaaaacaacaaaaaaatcatcttgttttaacttggataaatacgtatttatacttgtacccatggtaacaaatccacaaacaagagattatgacaaacaataattcactatttttgaggatccatgacatgtcaaacatttcaataacgacaaggattacaacaaatgtttagaaatggttaaaatagtaaaatgttacatcaaaaatatttgaaccaggaagatggggaaatctaatttggatgagagagaaaattgctgccaaaacacatcaaatatcaactttttcggaaacaaatatccacgcggattgtaattttttttgaattactaaactaatgtaaaaatttttaaatatattttatacagaaaaatcaaaaccaacgacaaatttatgcattgaccaaaccggttctataccacataatcgatgtttaagttattggtttaataaaatctataaatagaacaaaacctttaaacattcttataaaaagatgaatcgtttaattgaagataaggtgggcgatttacgggaaagcaaggtttataataatgttaatttatttaatgattgtgaataaatatcttcatttaatatgtaggagattccaaagatggatatacacatttctcagccgttgatggagatcatcgttagaaaagttgctgaagatggtgttgatgatttgaagaactggttgctagctgggagagagggaaaggatgctgttatgtcgaggaaaaccctagcctttgttcgcattgacatggacaatcattttatgtggtggtcaatgcctcattctaagtactacagtttcttccaaaagtgtcttgccgcaaataatccgtatgcaaagtttgtagagaagaacaaaggactggcgtatgagtcgacaacaggatactatcagatgaggtgccgatggaatgtactcacgacaaacgcatgttcattgacatgaataacgagaaaatgtgcattatgcatcttcctttccagccaggaagaatggtgaggcgtacgtgccctaggtgcaagaaagttgggcaaaggtgcaaaaggtgtctcgcttaaggtggatctcatgaataataatttctatgggtttttgtttttgttggatactaacatctaggtgttttttgtttttgtttttgttatattagattaagttgaacgggaatgtaaaccagtaaagattgtgatcgttaatttacaatgacatctaatgtccaattttgatttaatcatatgttctcattttcgttattggaaattgtttcgtttgttatccatctaagtaaacatataaactccaatgcatgaagtcttatccattaaaagacaattttgtatcatttgatataacgaaaattgtttagtttgttatccatataaatctataattaaaatgtggaaaaaaacataagagtggatatgtctacaaactagcatcggaaaaatagacatgttgacgatgggtcccttgatgtgtagcttcacaaacagtaatatccaacagataaattagtgtaaagggtgtcagtttgaagtgataacctgatgtattaggtctaaaaagtacgaatagattatgatatctacttgaagttgcttgaattatctagtgcaagtggattacatgtcatgttctgtaaaatatgtaactctgaaaattaactaatcctactcgttaggatgaataaatcaaaacgaaggaagataatagaatcgaaatggttaagcaatgatggatagtcgaattaggtcttgataaatatactaacagaaattacaataatttcggaaataaagcgattaaaaaacataaaaaataaaataaagagcaaaaataaaacaagaatattttcatagatctaagctgcgatctcaggtcttcaatgtcttcccgaagaacggaatctaggtctcacgtctcctgtgacaaagaggtaatcacggaatcacaaaaatttagccctttttgcaattttagtgtagaaccctcgatgttattcactttttctatcaatcttcggatctcttcaacgatacatgtatccgtccatttgaacaaatggttccaattttcctgtattattgatagttattttggatagcaagtagtagaaattattagataattagtagatttacttacggaagatcccaggggacatacataaaacaaacgaccagggttccttggagtagctgatgttttcatcactacttcctcgccacaagggcagacaatcgagatacctccaagtcgatctaccatgttgtagttgtgtggtgaaagttgtacgaggagactaagcttgtttctataggaaaccccataaatttgggttttatgaccatttgacaactacgtcgttctgataaaaatgtaaatgattaaaatatgatagaaattaaataaaaaatataattatggtttcaagtatacaaatctactagtgacaaatccactagtgacaaatccactagtgacaaatccatgaatattgaagtagtccatgaatacaaatccacaaaaacatacataatacaaaccgtagaaaatgatggtctcacattttttgtcgttattgattcagagcttgacacaaagcgaatttccaacaaactgaaaaattaatctatcacaaagtacggatcttaaaaaaattagtgaggaaaaagcactcggggcaaacatccaaactcccaatatgtagtaaatgacaatctgggagagagttcaaaatcttgtacccctggtatagttgttgtcctgttggagccctaaataattatcttgagagtatttagggttgattcgattggtatgatggagataaatacttagacgcagtgttttaatatagaggacaattaccgaatattatttccttaatttcccttattcgaaatccatggaaaactatccacattattaaatcagcggtggtaaaacattttgttcagctgaatatatttggtataaattgtatgtgtccatgaatacatatccactagaacctttaataaagttgtacgaggaaaataagcttgtttctataggaaaccctagaaatttgggttttatgacaatttgacaaccacgtcgttctgataaaagtgaaaatgattaaaatatgataaaaattaaataaaaagtaaaattatagtttcaagtatacaaatccactagtgacaaatccatgaatattgaaatagtccatgaatacaaatccacaaaaacatacataatacaaaccgtagaaaatgatggtctaacattttttgtcgttattgttaagagcttgacacaaagcgaatttccaacaaactgaaaattaatctaacacaaagcatggatcttaaaaaaataagtgaggacaaagcactcggggcaaacatccaaactcttaaaatgtagtaaatgacaatctgggatagagttcaaaatcatgtaccccctgtatagttgctgtcctgttggagccatgtcttgtatctgagtcatgacatgttcggcgcaattaacagcttcccaaaaattattaaacatctccaaatacgtttttggtattattctaccatcctctggattaccgcaaagaacataaaaaataccaaaagcaaaataagaatgtaagtaatgaactgcagcttcgccaagcatattcagagcttgaacagagtggccaactagagcagctagtcgtaacccttcgatgtatttggccgtgttgttgccagactataaacacctaagcaaaaatggccggtagggcgacccttcgatgcataaagaggagaccgtaataaactcatcaagaccaagctcctttaaaacttcatcagaaaatacaatagctacccattcaggtccagcagcgatgaatggacctagattacggaaacccgatattccaattcgacgaacaatgtatgaaaccaaacgaaaaggaatgtaagaaaacatgtcggaggacgattggaaaaaattataattattttaagagtttttagggttgattcgattggtatgatggagataaatacttagacgcagtgttttaatatataggataagtaccgaatactatttccctaatttcccttatttcgaatccatggaaaactatccacataattaaatcagcgttaatcaaacattttgttcggctgaatatatttggtataaattgcatgttttcatgaatacatatccacttgaacctttaataacttcgagaaaattagttggactaattctgagaaattaaaaattcagttcaacttatacaacaaacatataaagctagcgacaaaaagtaaataaagatagccgtgaaacaactgaaatgtctagaacaaatatcatatctaaatgaaaatttagttaaatggaaagctaattagctggtgttcgattggtaaagtggtgtgacaagttcttgaaaaaaaactatagcgtactgacccatgaattcattgacaatttcatctgtgataagggccattttctctgtatttccaccagttgcataaatttcgatgagcttcattgagactggtccacagtccccagacctctcgttgacataaatccctttcattcttgtccaactgaaaggagccaatccatgaacttgagcatacgaggctgacaaaatttgttaattatgtacgggatttgaatcacaatacgtgccatgaactcatcgacttgtcgatcatcgtttagctggtagtttggatcaagtatgtcaacacaccaattccctaatttgattgccagccctacccaatgctggtttttccaaatcattggcatcaggatgaggtcaatttcttcaaaccaatttgatggagaaccgtgaatcgtccactttttctggttattccattggacgcgcagcttattatttgcggcttgaaaggaacggtatttcccttgtaggtaattgcccaaccacagtttgataattactgcgcgttctttagagagtgtcaatatgttcctttcattaaggaaatttcctagtacctccatgtgctgcaagttgtttagcatgaatcatgtaattagcatattgatccacatgaactaaaatgaattaatagggagtttgttttaccatggtatcaatcctattgctcggctgtgcaagctggagtaggaatctgtgggatatcacaatatcaccacgagtcatgtgttccctgcaattattaaataattttagtttgtcgataaaacatcaaaacatagagaaaagtaaaaagggtaatcaaattacttatgtggctccttccggagggtgtcaatgaaatctttgaaattttgttttgtccaaagtaggaaacaaatcaatctgaccgtgggagagcatttgtttttttttttgcaaaaacaaaacaagttggacttctttttcagacaaagcagttggcgaccattcccttgcaggtgatgaatcactgacatcaacataagttccattattggcggaaacatcctaagatgttataaacaaattttaatattttgagaacgccataaataaaccaccattccaaatgagcaccaggaaattctacctcttcatcatcgctttcaatttcatcatcgctttcaatttcatcatcttctttttgatcatcgtctttttgatcatcttcttttttatcatcctacaagggaaagagggcataaagttaggtatccacgaagttaagtatatccacaattgggaatccatacaaaatacgtagtccacgtagataatggatgataatgttacctgtgggttcatgggtggttctcattctatcataacaagactctctttccttacctaatcgggagcagcaactgaagaacttatattcttgcacactgtgtcaagcaatgtgtctatattttcagccaaggacaaatccggaatcttaatctccttgataagatagaagaggtataacattagcatatgagtaacatccattctaagaaactcaaagtaaaatgaaaataacaggaggtcgaagaaaacctcggtaacatcattaggagatggtttcgttgcggtatcgaaaacagcaggaggtcgaggagaaggtagatgctaatgtaaaatgaaaatgtagttaggtatataatagttaaatatttttgacttgaaaccgatattgaaaaatttaccttttatctagattttgacttagtgtcatagattggttgatcagagggagggagctcggtgctattagcatatataaacttgggtaatataactgatggagtttcatcctgaaaaagaaccatctcagaatatataaccaatgttatggaaacaaaatatgaaagaacttcataaacaattaccagatgcttctgtggggaatcatcagaatccttgcaagtcttcatggatggagtttcatcctgaaaaagaaccatctgagaatatatgacccatgttaagtacacaaaatatgaatgaacttaataaacaattaccagatgcttttgtggggaacaaactgaatctttgcaggtctccatggatatcccatcctgtgtagtatatcgaagttaaagtagattattgactaatatctacgaaagtatacgaactttaatcaaatgcggcagaccttatcatttttaaactcacgccataactaatcatcaacaatcttttcagaattttctgatactgtttcgtctccatcatgcactgaatcagataaaacattgactcccccttccaatgaagttaatggtggtgaagggggagttgtgatttttgtcgctctacaacagggttgacaggagattgagagactgtggagaggtgtgtttgtgagcgtactttcttggatggatgacgagtacacggtcttgacctgtaagacttgacagattgcagaaccctgatctttttcagaagatttagattctgagatcttaacttcttaacactctccgcaaattcatgccttatagaagacaactgagacttcacccacaattttatgtcttttgcttcatcatcattatcttctgcttcatcatcatcaaccatttcaaaattacgcttcctgcctcgcgtgaatgtactaactttagtttttgatggagttcctttagaagaagaagttggcgaaagtttccttttccagataactatatgtttcttgtgttcaactacaggctccttttcattgacagaaatgagcggtagatcagcataactaccaggccactcctttttggtgaaattatggcattttcttatctattcaatcaaataaagaaccttcttgtctctcacttcatcatcccactcaccccaaccatcctcattagtgtttacaaacagcttcaggataacagtcatctgaagaaacagactcagaaaattagaccaaataaaaaaagtcataagagcacatgaaagaaaagataccacaacaatgtttacaattacttacatcaggaacacgttcaaggagatgaacatcgttgatagtaagattgcttttcggtatcccaattgaatgccattccaaaaacgttctctcatctgcagaaccaggaattttgtccagtagaccagaaatgttcctataagcaagaagttgcagggctaagggaaagccataaatagctatactctgctcttgcatctgatttgtgaattgttggatgggatcttctagcttgattccaggacgagacctttttctcttagaatcagccattgacggtttgttctaacaagcctcatgatatgaatagtcttcaaaaaagattctctcccccatgggaaagccaggaatgagtcaatgtcctctaacatcttaatatacttgaaagtttgacgatgagtctggttattagcaataaggactccatcaacaatcaaaagaagagccaggggagttttaaagggtcctcaatcccttttaacgcttggaacttagaggaaacatcagctagtgttacattcttatctttcccaatcaaaacatcccagtaatcattcgtcccattgacacgtctaggaaagtagtcaggttcatactccttcggaaattcaccacacggcaaactagttacagaaccaaactcaactaaagagaatctaagaggctgtccaccaaaaacagtccacatttcgtatttctgtttggtaactaactatctacataacaaagcatgaactagtttgctagatattggacattcgctaacccttcaactaaacagagacccaaaacaagagtctaagatggtttccatctcattggtacctttcaatacttcacttattacagtcagaatgtcgggtctggattagatattgagacgtgcatcagggtaacggttagttgcaaatagcctaggaggaagacgagtgtcgagaacatttatatcagcctcaactgtgcctgaaatcaaagggacgatttgtgaagaggaaattatcgatctgcaactgagattttagaacaacaatggataaaatataaatttacctaactggtaaagaaattttggaataacaatggcttaaacgttcagataactataattggtagaagaaaaaagaaaaacatagtcgattaactgtttaaaatattattgaattcctcaaccacatgaaattaactatggttaacttacttttgaggggcttatggtaaaaaaacttaaaaaagtacatactcccataagagtgctccattgcctaattagaactcaaaaaagtgcccttctgcctaatattccctaaaatctaactattttatctttgtcagcgtaacgacatactcttctgtgtatgatttagttataaagtttagttacgtacattattccggttaagcaaacatattttatttttaaatgttttgtgcgttgtatagtaaacaaagagattactaacattaaaaaacaatgtgacatcaacatttaatgtcaaaaaagtttagacatgactttcgtcacaattaatacaaaaattatcattacttgttctaatattaacttatacttgtgaataattgtagagataaagatgaaccaagaaacaaacaaattctgaacgaatgtgatgttgaaaaagttttgatcttttttatttacaaagtttggagccaagacaaacattgatcgtgtaagtaatgaagttgtttaagaagttttttgttataacacactaggatttttgattgtgttcgaaattaacattgtttttttatataaaaccccataacttttttatttccaattttatttgttgaaaatggtaaatgagtatatatttatgtttataagtgtgtatatcaaaattctatttgtttttagtagatataatcatgttttcagatgcattaaatgaggttctactgaatttataattcaagtgggtaatggatattctcgtatttactatggtgggtgagtggagatgcaaagaacaagaattgaaatttgaaccagatgaatgcatgtttggtcgctatgtacgtgttaaggaaaacatgacgtacacggaatttgtgcatatattatgcgaagttttcagtttgaagtacaccgaatgcaatcccataattagttactggatgtcggaaaagatgtctatgatgatagaaagtaaacgctctcatgtctacattgacaatcaaatgggcttggatacgttctttttgatttgtggtggggatcttagtgtcctcttgtttgtctctttcattaaattgtcaaggcactcgggaacaatgtctctaggactgatggtgattgatatatcatggtttttactgatttctaacatagtttcagaatagtgttagtctttccaatctttttcttgtgttttgagtcattacaggtgcaattatgcatttgagagctatgaagcataataaggaactttggaagctttttcagcaatgaagattatccgagacgttttcacgcggtggtgtcgatcgacaccacatctatgtcgatcgacaccacatctatgtcgatcgacacccatatttggcaaagggaattttcatgattcactaagtgtttgagaagccccataaattttccttatttgcaaaatagaccctgtacgtttttaagtaacctatatacataattttatggtcattgtttagacctaagcttatttttattgagagatacacttttggagagaagaatctaatccttgcagagaggattctgacctcccttttactcatcttcatattataattcaatgcaatttaatcagattttgataatttttcagtaatcaccttattgggtttagggagtctcactagggatttaattggattagtagattgataaccccttaggattattcttagagttcttcatctataatggttctgactgctagttttagattgatcacttagaacttgattttagacaatagatatacccgccataggtatctgttatcagaactattatagatgagcctggtttataggtgtgtaataagaatcggcctatctacttaggtgaactaatcaaacttgtttagcatgcaagtttaggaataggtttcacggcacgtcaccgggaatcttatctctaggaatagtgagtttcacggaatgccaccggttattttgatattagagtttgagttcaataacggttcaataacaatcattttcatagctagatctacaatttatctatttcctgaaaccatccctagacctaccactttaatctcctgaatctacaactcaatttactgttttattatcttttacttttacctactttttttggcataatattaatcaccataagtctattgtgtccacatcgagagctcagtggaattcgacccttatttgctaacaacgatctcttatttgagggagtaagcttaagaatatttgagctatatcaaatttggcgccgttaccgaagttttctttagttcaccattagagtaggtgtcaatttaagtctagacttttcttacacttcatctcctcacgtgtttctccttcttttggtctcttgtgtttcaggtacccaaagaatattatccacgtttctatggcagaattcttcgacagtgtcgatcgagaccatctgcagaaccaaccggctactataggcgactttaatagagctgatctcttctacacaaaccgatcagcaatcgagccacgcactttcgaaagagaagactttgctatccaccctgtctattatgatcttgtttcacgaggaaagtttagaggttctcctggtgtatcaccactcgatcatttggaagtattcgaagacttcgtgtcctcaatcaaagaagatggtgtaccagctgattaccttctttgcaaactcttcctccactctcttgcgggtagagaaacatcatggctatgagaactcgaaccaggttcactaaccaattggattgacaataagaacgcattcatgaatcacacaaggcaatggaaagcagctcaatccagtacatcagatagaacgattagcaaaagccccaccttcttcagtcacaaaaaagcttcggtgttgatcgatacactagggtgtcgatcgacaccaattgatattgataactctgttttgcctatgtcgagtgaaatcgacaatttcacagaggaggaacttatacacgatagtgtcgatcgacacccacctcaggtcgatcgacacctagctcgttcaaacaatgttcaaatctcagctgaagcaaagttagcaaatcataagattctttttcgtaagtaccccaagaaggcgagacaagctttagatgatattagatgatattgacaaactgattattgagatgcctcttattgaagccattcatctctctcctacaataagaatgagtgtagtgttatgatgatcttagagcaaggcagcgatatcatttaggaatggaccccgagggaactgtcagaccctgaaacctttgcactcgacgtaactatcaataactatgccttcccaagagctctatgcgatcttggttctagtgtaaatctgatgcctcgctctgtagctatgagtctcgggtattcaaatcttgagcctacttatatcactcttgtactagtagaccgctctacctgcattccacttggtatccttacagattttcatgtgatgattgggactagtatgatttccacagattttgtggtcttgtcttatgagaaggaacctaaggacccattaatccttgggggacttttcttgcacacagttggagccattattgatgttcgaaaaggaaggatagggctgaatgttgatgatcttactatgtagtttgatatgaacaggttagttaagaaacagattatagagggcagaacaatcttgataggttctttcacttcattagcttcagagagtatttcagagatggagatagagtatccactagagcgagctttggtctcttccatagaggatattgcggatttggacagtgaagcttctacatacactaagatgctagatgagaccgaacatgtgatgcaactaatattccaagaagatccttcatctatgattccaaaactaaatactaatgccaattgggatccaacaaaggcccctaaaatcgagttgaaacaacttctagcagggctaaggtacgcatttcttggtgaaaaaattcttcttaccctattattgaaaatgcttctctaagtctcgcagagctcaccttactgctaagcaagctgcgcaagtatcgcaaagctctttgctattctcttgatgatattgcaggtatctttccagatatatgcatgcataggatccaccttgaggatgagtctaagtcttcaattgagcatcaaagaagactaaatctgaatctgaaagatgttgttaagaaagagattatgaaattgttggaagaagggatcatctatctgatttcagacagcagttgggtaagtccagttcatgtaggtcctaacaaaggaggagttaaaatagtcaagaacaaaaaggatgagctgattcctactcggacaattacaggccattgaatgtgcattgattataggaagctgaatgctgcaactagaaaagaccacttccccttgccatttatcgatcaaatgttggagaggttagcaaatcagaagtactactgttttcttgatggatattcaggtttctttcaaatcccgattcatctcgatgaccaggagaaaaatactttcacttgccaatatggtacatttgcttatcgaagaatgcctttcggtctttgtaacgcttccgcaaacctttcagagaggtatgatggctatcttcacggatatgattgaggatatcatggaggtctttattgatgatttttcagtctatggaccatcatttgaggactgtttagagaatctctgcaaggtattgggaagatgtgaggagaaacatctagttttgaattgggaaaatgtcactttatggtgtaggatgggatagttcttggtcacatgatttctgagcatggtatagaggttgatagagccaagatcgaagtcatgacaagccttcaggcgcctagaaacgtcaaagcagtgaggagtttcctaggtcatgcatgtttctacaaacgattcatcaaagattttagaaaaatcgccagaccattgacagctctactctgcaaggaagtcaagtaatgtgtgatgagagtgattttgcagttcgggttgttatagggcagagaaaggataagaaactccatgccatctattatgcgagtaggacatttgatgacgctcaaacaaattatgcaacaaaagcgtaagagttgttagctgtagtgtttgctttcaaaaagttcagatcttatcttgttggatctaaagtgattattcatacagactcatgtagctctgaagtatctgatacaaaagaaagatgctaagccaagacttttgagatggattttacttcttcaagaatttgacatcaaggtacgagataagaaaggagttgagaatggtgtagcggatctattgtcatgcattaggattgaaggtgatgtccccgttaatgatttcttgcctgaggagaacatatatatgattgatacaactgaggaagatgactgcgaaattgttgtattgcagaaccgagctatagtgtcgattgacactcacttcagagaaagggatgatgatcgatattgctcgatggtgccattccctatctattagaacttgatgccattccctatctattagaacttgaactgaatttgcaattatcatgtctatgcattgtttgtgaactcatggctaccatatacatacttggattatattattcacttcaccaccctttgttaatccaagtagctgactctcattcttagagcagtttcccatacctgaccctaaccttatttcaagccaaagaacatttttgtgtgattgtgaggtcttttccgattgagcttggtataacgtgttaggtatgagccgacaagagcagtctttcatgtagacctagcccacgctttttgggttagctaggactaggtggagacttgtatttgggattgggattgtgtatggaatgagtgggaaagagaatgagaatgaaaagaaaagaaaaaaagagagtaagagtttagagttcttaagggggatagaaaagaaagtgttagtctagtaaagggtttggaattcaaagaaagttaggcattgtaattcaaagaaaagggtaaaacgccttctatgctaagattagaagaaaagccttaagtttgtcaaagtttaaaaccaaaccgctagactcttgaatcgttttaaagaagcaccccttagaacttaaaccaaaaaagagaaagaatgggaaaaaggatagagttaggtagatgggagtctgttcttgtatgtgtctgttagcttttacctttagcattatgctaaagctcaatgttttctatgagagtcccctgttactcgaccatatcattagagggaccattttttgtctcttagcctaagcccgaaaccaagtgagttcataaccatcgcattgcttgatctattgttcgggcttaataaatgttaaaaggaattggttgatgtgaatgcttaaatagattgaggcagttgttaggttgcattgtgacgagtatggctaaggtttttaagtaaggatctatcaccatgcaacctagaattagcttccttggacattgatttctatatgcatgcttcggtttttgaatccccaccttcaaacctctccttcaacttaagattttttgtttgcttgagggcacgcaagagataagtttgggggagttgataacactgtattttactcattttaggcatgtgtttatcatcatttagcttagttatcactcattgtatcatatcattttgcatcacatttagcttattttgcacacttaggtatttgggatcatcttgcatacattgcatgttttggtgtgttttcaggtgtagaaggagcttacaaggaatctaatcgaccctctacactatcaaaccaagaggaaagcagcagagcaattcagtcgaccccttttctcgatccaggaagccacagaggaggcagccaacactactcgaccctccactcgatcctctactcgaccagttactcgatcaagggcaacctactctacaagacttgttgatcgttcaaagcgtcttctgatcctcctcattccccactcaaacagacatcagagcataagaataggagaggaagaagcaactactagaccaattgatcactcggagcatggaggcaaaggcgcaaactttgcaacactcgttccccaagattgagcattcatctaaaccgcctcaagtctcttgtcttctagtaaatctaaggttttcgagatttcagtataaataggtcactttggggtttgtccaaaggaccaagcttttatctcttagtttttctttgtgttttagaatcttgaaactttaattacgcttaatctatttcgtttttgcatttagttctctgagcaaagttgtttatcttgtttagatctacattttgctatatttagagtaatttctgggtttgtgttcttaattatgttgcttgagtagtgattagggttcttgaggatggattagattagggtaatcactaggttagtcaggtggttaagattaggtaagatcccttctggattcgttggcccctatgcggttttcgctggctaatgtgagaattcgaccacaggtatccagcgtccaaaagacgttcaaatggatgtctgatctaggaattccagagatttgtagattctagcccaagaaattggatgtttagactgcttgactttggtagattgttgcttaaagcctgctctgctatgtttcatcaacgagagttaagattaggaagtggtaaagttatctgtgtctttgtcacgagagtggattgacccggttttgaatctatcatctagggtatttgcctttcgcctgttagccacctgagggcatgatatgatattgtgagacaagacttggaacttgaaccaatggagcagcttgtagccgaggagcagcttgtagctgaggagcagcttacagcggaggaagctttgtacggaaccaaccagtcctatgactcgttcgaagactagacttctcaaccaagctgttaccggacttcttaaccacttgggcaagcatccaaacgaagtcatactaagcgtttggaactcaatagcagctcaagacaattggtaattggctaggtgttacttgggtactctttttcccttctaaggttttgccccaatgggttttccttagtaggtttttaatgaggcttgactaacacttcaaaatcccccattatcaatcccgcccaagcccattaagacgaccacgaatttggaaggccaagggtcgtttttgttcaaactttcatttaaatatttttcctttccgagttatcatggagcttgttccaagactaacttttccccttctcttcttatctatttaaactcttgaatttgctctttgtagactcaactatcttttaatcaaaaacctttttacgttagatcaatctcttgttcttctctttggtgcgtaatatccaacgacgagttcaagatcggtaaatcaaaggcttttccgcaacctttgtgtgaccatttgccccacatcctttcatcatagtaatctctcgattgctttggatgcaaagcctatctcgtactcaacctaaagagtgtcggtcttagggaattcatattaacacatctcctaaagctgatagacttcacctctagagtcaacaacagagacccttacaactcagcccacagatgagagctgtagagaatcagtattgattgacactacacaccctgtcgatcgacaccatcgtgattcacagacatatgcttctgcacctccttcacagcccacacctatttcaattcccagtgataggtactccactatctcttctcctactgttccttcgattacttctttagaatcttcgaagtgtggttcaccggtaaacgagcatcgagtttcttgaaagcttgtttcttctgttgatcttgcaggacaaggagggagtatcgatttacacaccgccttgaaaagcgagattgcagcacaagtcctccacccctctatccaagtcctgaactccgccagtcaagctattgactctaaacaaacgctaagtgggagccaacccactggtatgatttttctttttcttttcttttatatttattttttccgctctcttcggatttgaatgccactggagatactgatatttaagtctgcgggaagcgcttattaactatgcttttattttttattcttattaaatttttttaatgttaatttagtcatatttttgttttctagaatgttatgtaggtggatatagttgtggaacttaagtatggaatctagaatgttatgtaagcttgcggagaagtacatgttggttaggatttgattagacttggtagtcatatggattggtttagaatgatcatggcaatcgactagagaatgttgagagtttctttgttttaaaaacctcttccacgggttcggcttttgtgttttgcttgagggaaagcaaaagctaagtctggggaagttgatataaccctatttttcttgtttttaactatgttctagatgtcggtttttgagtcttcttgttatttctagagtctttttagagtctttttaggtattctatggagagagacaacaatggagatgagaagacatttgggagcaaaagctgaacaaaataagccaaaggacaaattcagttttagatcaagtcgagagtgtagatcgacacactcttggtgtcgagctacaccagttgcggcctagagacgtccattacgcttttaagtttgaaaaattggaaatttgttctcgaatgcttctctattttcattattagtcactgcacgttttttaggtcatatatatagttttaaaggtcattgtttagacgtatcaagctttttatcaagttttctagaaccaagtctttttccaaagcactttcataagatattcatccatgtttcatcaaagatttcaataagagtgaagagatcttctctaactctttttgctattgatttgtttatgattttgtattcatacatgttgtttgtttcatccatcatgtctgagtagtctgcttgttagggttaggatttctcagtagggattcatataatttagtagatcgctcccttgcaaggttatctgtaggattcttcatctttagttgctcttaatgctagttctagtgtaattaactagaacttgatacgagataatagacatatccaccataggtatttttaccagaacaactatttgatgagcctggtttataggtttgtaataagaactggcctatctactaaggtgaacttatcgaactcgtttctcatgcatgtttaggtataggatttcacggcaaatcacccggaatcttagctctaggcatagtgagtttcacagaatatcaccggttattctgtaattagagtttgagtttaagaacggctcgataacaacctacctatatctagatctactaatcatctgttttctcagaatacactaaaccagacgttttattatcttgatttacaaccaaccaaccttctatttgcctatttactttgtttttattttgttaaactcatctagcttaatcttaccacttaggctcattgtgtgaacaaaagaactttgtgtaattcgatccttaagtactatcaatgatctcttatttgagagagtggtcttagggtaatttgacctgcatcaaccgtagttgaggcttacgaagtgtataatgacttctcttcattacatggtggcgagttggagattctcgataatgatgttgcttcggtatttgattatttagccaatttttgagccgatgagacacaaattgaactcagtacgacatgtgcaactttgtatgtggggtgtgtttctaagaacagaaaagtcatacaacaaacaatgttttatctcgcaatcaaacaatgcttttgctataagcaacctagatgatacttgtccatgacatttgactgctcaagtcgtcaagaattcagaatgtttcaaatcacatagtatgataccacccatacgtgtgacatcgacactcgcatgaattataataaatatgctagtgataagcttcttggagaggtagtgaagagcagatacagttctacgcaagggggtccaagagctgtcagtttaccacagttgctcctaaatgatctcaatgttcggatgtcatattctaccgcttggagagctaaagatgttgcagtggaaaatgtaaggaggatgatataaaaagttacaggtttttggctacctatttgtatcttcttaaattagctaatccaggtacaataactcacctacactctgcacctgaagctgatagtaaacaacactttaagtatgtatttgtatctctcagggcttctataaaaggtctgaagtatatgagaaaggtaactgtcgtagatggaacacaactagtaggacgttacaaaggatgtatcctcattacatgtgcccaaggcggaaactttcaaatattttcaatagctcttggtgttgttgatggtgagactaatgcttcatgagcgtggttctttgataaattagctgacattgttcaagacactgaagatttaatgattgtattagacatacattcttctatatataaaggcctcagtgtgatttatctgaaagctcatcatggagcatgtgcagtacaccttgagcgaaatatctccaactattatggtaagtatggtgtatttggattattctttagcgctcctaaagcttatttacgtaggtgatatgaagcgtttcggtacattaattggaaaccgtgtacttagggagatttatgtgacaagatagatgtcatatctatggctaaaatttgaaagtatgtaattaataaccaggcgaaagctccgaatggacaaagcgtatttggtggagcggatcaagcggataaggtgtttcaagcagaattaaagccgatcaagaggattaggtgttttaagcagaactaaagcggatcaagcagttagaacgcttcaaaatatgtattgaatgataaaaatggatcatacggtgcaaatgaaatgatttattgagaaaaatattaattacaaatatagtataatatacaataaaaaattgttattaaatttataaaattaatttaacatatttttgaacatgtaattatataattcaattttaaatatttttagaattttattcattatttagcattatagataccaaataaaatgctaataagtaataaataaatttttattatataatatataacaaaagaaaatttggataacatgtttggttggataaattatatataatttatttttaaaatttgtaaaatcaaatgaaaaaagagaatgattgcaaatcttcattttttaggtaacaatattgaaccacaagtggttcatgaatattttgtaatatttaaataagttctacattaaattgaatttataatgttgaatgggcacaaagacacagttcatctgcatcaaacattacgaccgcttcatttccactctccactcatagccaaaatcttgtatttacatcatcatttactagcatctcgaaactcgcttctcatatttgttgtttgaaactaacaaaatactgtgtgcaataaattatacatgtatatgtataggttaggagaatatatttgtttaatatattattaatttgatgttttttggctaaactaggaggtataaaataagtgtgagaatccttaaagtatgagataatacatggaattactaggaaacaagcaagtatatagataaaaaaaatatgcattattgataatcaaagtataaatctcaaatcccacatattatgacacaaaaacttataaatttgaaagaaatgttaggaaagaaagaactagagaatttttctaattcttcttacacactacaagaggtaatatttgttgcaaagatttttgacgggtccaaatctgatgtaacacatcatcgcgcaaggaggcgtttgaatgccactgagacagtgacgtttaagtataggggagacgcttattaactatgcttttattttttattcttattatttctcgtttttatgtttattaagtcatatttttattttctaaaaaaaatacacgtttttgtttagtctagctaggaatcatgatctatatgtctttagattattgtctggttgatgaatgatgcaggttcgattcaattcaactattggaatatccagatggcaaaccgatagacttgaggatatcctggtttccaacacaatccattaaggccggagctaatctcactgctcttcctattatcttatcaaaacggttagtattcatagaacttgactccttgttcatatatacctgatattaagaccaatatgaaaaaaagtattcctctttccttataaaaaaaaagaagcaagagattgagatgattttcggtagtgtataggagtaggaatgttttccatgaccacatgattatacattattaggaataatcaattacaaaggttggaaatatgccgagagtgtcaatccactatgctagttcacctttgtttactcatcaaaaagaataagtctgggagagaaagaataccaaaagaagataaaaaaatataaagaatggtcgatttatcatggtatagtacatgaatgagtctagacggttcttgaatattagcttgcttgatgagacccaacaatgaaagcctggtggatatagctgtggaacttaggtatggaatctagaatgttgtgtaggcttgcggagaagtacatgttggttaggatttgattagacttgctagacatatgaatttgtttagaatgatcttggaaatcgactagagaatgttgggagtttctttgtttttaaaacctcttccacgggatcggcttttgtgttttgcttgagggaaagcaaaagctaagtctgggggagttgatctaaccctttttttttttactgtttttaactatgttctagatatatgattttgagtcttttggttacttcttgagactttttagagtctttttaagtattctatggagagggacaacaatggagatgagaaaacatttgggagcaaaagctgaagaaaataagccaaaggacaatttcacttctagatcaagtcgagagtatcgatcgacacactcttggtgtcgagctacaccagttgcggcccagagaagtacatcacgcttttaggtttgaaaaattggaaatttaccctagaagacttctctattttcattattagtcactgcacgttttttaggtcatatatattgttttaaaggtcattgtttagacgtatcaagctttttatcaaattttcttgcaactaagtcttttcccaaagcactttcataagctattcatccctgtttcatcagagatttcaataagagtaaagagatcttttctaacacttttctctattgatttgtttatgatttcttattcatacatgttgtttgtttcatccatcatgtctgagtagtttgcttgttagggttagggtttctcagtggggattcatatgatttagtagatcgcccccttgctaggttataagtagaattcttcatctttagttgttcttaatgctagttttagagtaattaactagaacttgatatgagataatagacatatccaccataggtatttgttaccagaatcactatttgatgagcctggaatataggtttctaataagaattggcctatctactaaggtgaacttatcgaactcgtttcgcatgcatgtttaggtataggattttcccggcacatcacctggaatcttagctctaggcataatgagtttcacagaacatcaccggttatcctgtaattagagtttgagtttaagaacggtttgataacaacctactgatatctagatctaccaaccaacctgctatttgcttatttactttgttttcattttgttacactcatctagctaattaatcttaccacttaggctcatcgtgtgaacgaaagaactttgtggaattcgatccttaagtactatcaacgatctcttatttgagagagtggtcttagggtaatttgacctgcatcaacagtagttgaggcttacgaagtgtataatggattttcttcactacatggtgacgagttggagattctcgataatgatgctgcttcggtattcgatgatttagccaatttttgagccgatcagacacaaattgaactcagtacgacatgtgcggctttgtatgtggggtgtgtttctaagaacagaaaagtcatacaacaaacaatgtctttatctcgcaatcaaacaatacttttgctataaggtcatggcctacaagattggagatagtttgcattgatgatacttgtccattacatttgactgctcaagtcgtcaagaactcagaatgtttcaaaatcacatagtatgataccacccatacgtgtgacatcgacactcgcatgaattataataaatatgctagttataagtttctcggagaggtagtgaagagcagatatagttctacgcaagggggtccgagagctgttgatttacaacagttgctcctaaatgatctcaatgttcggatttcatattctacagcttggagagctaaagatgttgtagtggaaaatgtaaggggggatgatataaaaagttacaggtttttgcctacctatttgtatcttcttaaattagctaatccaggtacgataactcacctacactctacacatgaagctgatggtaaacatcactttaaatatgtatttgtatctcttggggcttgtataaacggggtgaagtatatgaggaaggtaactatcgtagatggaaaacatctagtaggacgttacaaaggttgtctcctcattacatgtgcccaagatgggagggagaatctagttgaagcaagtacggccaagtcatgaaatcgtccatcgctatggcgttgatgtcctttgtgttgaccaagttccagagtgtctcgataggggtctgcttcacagaaaggtagttcacgaggatggtaacagggtttggcaattgtattccaaggtacattttggttggaggagttgctggaaaaggcatggtgcgtatcaaggaggtatacagattttgctggagttaatggaagaggtttaagaataagtgatgctaataaataagtgtgtgagatatcgtttttataggggagaacgaaatgaatgtaactggtagggcatttgttttttttttgtcatcagcttttaattagaactcaaaagagccaatcttgagaaaaatagtttacgtatgtgacacgaagcggttcggtacattaattggaaatcgtgtacttagagagatttatgtgacaagacagaggtcatatctatggctaaagcttgaaagtatgtaattaataacaaagcgaaggctctgaatgtagaaaacatatttggtggagcggatcaggtgtttcaaacagaattaaagcggatcaagcggattaggtgtttcaagcagaagtaaagcggatcaagcggttagaatgcgtcaaaatatgtattgaatggtaaaaacggatcagacggtgtagatgaaataatttattgtgaaaaatattaattgcaaataaagtataatatataataaaaaattattattagatttacaatattaatttaacatatttttgaacatgtatttatataattcagttttaaaatatttttataatagctgtaaaaaaaaaagaatatttttataatattattcattatttagcattatagataccaaataaaatgctaataagtatataaacaaattaaattttataatataatatataacaaaagaaaatttggataacatgtatgtttggataaattatatataatttatttttaaaatttgtaaaatcaaataaaaaagagaatgattgcaaaaatcttcatttttagttcacaatattgaaccacaaacggttcgtgaatattaaataatatttaaataagttttacgttacattgaatttataaggttgaatatgaacaaagacacagttcatctgtatcaaacattgcgaccgctgcattttcactatctactcatagccaaaatcttgtatttacttcattatttactagcatctcgaaactcgtttcccatatttgttgtttgaaaccaacaaaatattgtgtaaaataaattatacatgtatacgtataggttaggagaatttttttgattaatatattattgatttgatgtttgtttgctaaagtatgaggtattaaataagggtgagaatcctttcagtatgagataatacatggaattattaggaaacaaggaagtatatagagaaaaaaaaaatgcattattgataatcaaagaataaatctcaaatctcacatattatgacacaaaaacttagaaatttgaaaggaatgttacgaaagaaagaactagaaattttttctaattcttcttacaaaccaccagaggtaatattctttgcaaagattcttaaaggatccaaatctgatgtaacacatcatcgcgcaaggaggcgtttgaatacccaacactcagggtacgaaaaagttgcgccgtaagtgttatttaaaataattccatttttctttattttttctcgcaactcctcacacatgtcacgtgtttcttctaatttcaatgcataatggttgcttgcaaaaagccgaaggtacagaccacccatatgagtattaccgtcatatatgcaaagaactgcacaggccagggttgcatcgacgtgccttgatacatttcggtgtaaaagtaaaatagtgtctagatgcagtccttcatggtaaataacaatcaggtaaccagcctccagacacctttcgaaaaagggtctatatcgaccttcgaagtagatgttgtttggatcatggtctgctgaaacaacccaacccatttttttaaaatataattaaatattccaataaatatctaattaaaccaaccaataaaataacaattaaaccgcaagtcaaaaataatattttatgaatcaataaataattcgaccaacaaaaccaagaataactaacaatcctaaccgggtccaataaccaaaaacaccaaaaataaaacaaacgagttcctagatcatcctctcttccttgccatgattcaaggatcacactttatctttacttgcatcaacaacacaatgagatgcgtaagtattatcataaatacttagtgagccgatcctcccatctacgagctatacacacaagcaaataaaagggtataatcacaaacacaatacaaacaaaccagtcattgaacaattcacccaaaacacattcaccacacctacatatcatcacacaaaacaaatcacacaacccaatcgctcagataagctcatggtcacgcactcaccttaacaaattgattctaataacaattaaactcgggagagactctccttgcgtctgaaacagtccagaaacgtcctacaacaagtcacaaccaaaagcaaccttgaaacaaactggacaagaaaaacagaaacaaacaacctcaaagacgaaaccctaaaatacaaagtaactgttaactattcaatagctccagtcaaacgttagccctagacgtcacgacgcttcccacaaaatatcgtcctgatcagaaaacagacgagaccacgatctcaatttcaatccccgctggtcctaattcgcgtctgagaaaacgtgtctcacgaaactgcgaataactcaaccaattgtaatccaaatcaagttctgtaaactggagaataacaataaacgacttggaaataactctacctaattttgttacctttgaccacgatttgatatgacgaaacggatttctcccaaatcctaacgattctgctccttctccttctctctctttttttcctttataaaacgaaaagtggctaactaaagccctaatttcgagtttccttcttttatacgcacactctagggtttccaattaacccaaccaattaaaccggacgatttaaaaacaaaccctaaccgattttccggttcacgggcgttacaattctcccccactaacatagattcgtccacgaatctagcttcacccttccactccgagggactccgtgcaaccatcactacggtccgcactccctccaaccagaccccctctaggtctctttatccagtcgatatactcacgatttactagtcattgttgctcacaactcactctccactctcagaccgcaatctttgagcataaaccgtcactctctggccttggctacggtatctcgggtatcacacatattatcttccccactcaaagtcaaactttgagttgtgtcgtcttactctcagccacaaagtcatcaagttacgacacttggagaaaacaataccacaaaactcgctctcgggtcgccaccctaaagcgtgttctcggatcgtaaccctgaagcgtgctctcggatcgtcacccgaagccaccgtacccctcgcactctaaatacatcaagtccctcgagttaccggtacctcaggagcatacccagctcctcacgagtcgttgggaccctcatgtccctcgagcaaacaatactaaatgcttccgagcaaatctccagactctctcatggattcgcgtaagacatctttatgcctcaccatccatcatatcccctcgagaacatccttatgaccaactcccggccatctcgtaaacacacctttctcttaggttgtttactcaaactttccaaaaatagacaagtcctttttgggaaactttccatttttggaaattgcacaacacattcttaaataagacaactcaagtcaaaaccaagaaaaatactcatcttattaatcatcaatgtcatgatcgttacaactccaaacgaaaatacaaatgaaagagaaataagaacaacaactcaaaagctcaaaaactcaataacactgaaactggaaaccaatgataggcaaactcatgcagcaacctgcttctcaaagcacttcttgaaccttgccttcatcctcgcatctggctcccaagtctcctctgtcacaccatcgcagtcccacaggactttgatcaaaggaatcttcttccgccgaagttccttgatcctcctctcgagaaccctcactggtctcgcctccaaagtcatgttgggctgaagatcctttggaatcttagccaacacctcatcatccttgtgaagacacttcctcagcatcgacacatgaaagaccttgtgaaacgcacgcataacatcaggcaactgtaacctgtatgccactggtcccacccgctcaacaatcctgaacggacccatgtacctcggactcaccttagtctctgagatagacctgttcggacattgcaacatggccatcttgagatacactctgttcccaacctcaaactcaagctctctcctcctcttgtcaacataactccgttgtcgatcctgagcttcctttatgttcagcttaagaacccggatcctctccgtgctctcctgaacataatctgcaccatatatgctcctctcccccacttgggtccagcataacggtgtcctgcatggcctcccgtataacgcctcaaaaggagccatcccaatactcgcatgatagttgttgttataagcaaactctacgagactcaagtgatccgcccaatgacctccccaatccaagacacacatccgcaacatatcctcaagcgtctgaatagtcctctcagattgcccatctgtctgtggatgataagccgtgctcatctgcaacttagtgcccatctctgcttaaaaggctctccaaaacgcagaagtaaacttggaatccctgtctgatacaatactcacaggtactccatgcaacttcacgatctcgctcacatatttcttagccaacaccgtcgctgcgtcggtttttctgatggctagaaaatgtgctgacttagtcagacggtccacgatcacccaaataggatctttggttcgcgacacaggtaacccaaccacaaaatccatcgtgataaaatcccacttccactcaggaatggataaactctgcaacaggccacccgacacctgatgttcagccttaactaactggcaaacatcgcactctgcgacccaattagctacatccttcttcatcccgacccactaataataccgcttgaggtcttggtacatcttagtccctcctggatgaatagaaaacatgctcgcatgagcctcactcaagatctcccttcgcaactcctcatccttaggcacacaaactcgcccatgcacaagaatagtcccattagctgcaaactgatactcagagccctctgccttagaagccgcaatcaacccctcatctttctcctgagccaaccgaactctagtcagaagatctgctcgatccacagcttccaatcccaatggctctcgtgccacaacacacaaccgcaaagcaccaatctcactcaccaaggcctcaacactctgccctggagctgcacccatgcgcttacggctcaacgcgtctgcaaccacattagccttaccaggatggtaagctatctccagatcataatcagccaacagctccatccattgcctttgcctcaagttcagctctggctgagtgaatatatacttcaaactcttatgatccgtgaatacctacagtttcccgccataaagataagacctccaaatctttaaggcaaagattactgcagccatctccaaatcgtgagtacgatagttgccctcatgcttcctcaactgacgtgatgcataagcaataaccttcccacgctgcatcagaacacaacccaaaccaactctcgaggcatcagtatacaccatgtaaggctctccatgctctggcaatgctaacactggtgtactcgtcaacatctccttcagactcacgaaaccctcctcgcactccggtgaccacacaaaagggacatccttccttgtcagcttagtcatcggctgtgccatactcgcaaaccccttgacgaacctcctataataccctgccaacccaagaaaactcctgatctcagtggcattcgtcggtctaggccactctctaattgcctcaatcttccctggatctactgaaagtccctcttcagaaacaatgtgacctagaaaacccatctctctctgccagaacctgcacttgctcaacttagcgaacagcttctgctcccgcagtttctccatcactctcctcagatgtacctcatgctcctcatgactcttagaatacaccaggatgtcatcaataaagatgatcacaaactcatccaaaaactcctgaaacacgctgttcattaacctcatgaacactgcaggtgcattagtcaaaccgaaaggcatcaccacgaactcaaaatgtccatatctcgtcctgaaagcagtcttacgaacatctgcctcctctatcgggatctggtgataacccgacgtcaaatcgattttggagaaacaagtagcacccctcaactaatccaacaactcatcgatccttggcaaagggtacttgttcttcacagtgacccggtttaacccccggtagtcaatacataagcggaaactcccgtccttcttcttcacaaataacaccggcgctccccaaggtgaagtactaggacgaatgaatcccttacccaacaaatcctctagctgcttcttcacctctgccatctctgctggagccatcctgtagggtgccttagacaacggcgctgtccctggttccaactcaatcgtgaaaggatcagaccgtgatggtggtaatccctgcaacgattgaatcacatcctcgaacgcttgaacaactcgaatgtcgctcactgctacctgccccacagactccggcatagatattgtcaccaggtaagccttgcagcccttctcgatcattttttctgcctgcactgctgagatgacgagactccctgaggtaggtctcactctctgataaaccaacctcccctctagccgctaaaaaaaaactctcctacggtggcagtcaagatgtactctgtaatgatccaaccaatccattcctagaataacataatacaattctacaagactgataatcaaatttgctggcatcgactcccctgcaatctgaatatccacacccttcgctctccccaaaaccgctagaaactgccctctagcaacattgacggctccaaactgctcaccaggatccccgcggatgttgccgcacgaggcactctccggggtaatgaagcactgcgatgctcctgagtcaaacaacacatgggcctctacaccgcccactaataaggtcccagtaatcgctctgttgctggtaccgcctatctcacgcgtagtgtaaccctgcggtgctgctgcaatatgtgctaactgctgcactccctgctgcaccagcgctccgtgctgcaccgccggctgtattacagccactgtcatccgctacagcttaggacaattttgcctgagatgtcccctctccctgtagtgttagcactccctcgtctcagctcgctgcgtgcaatccgctaccttgtggtcaaggctcccacaagaaaaacaatatgcccgaccaccctgtccagctctggaaggatgatcccacttcctcttctgcccatgcgcaggcttgacgcccttggtaggtgcacctgctgctgagtcttcttcggttgtaccgctggactcactgccaccacctacctttgaaggtcctcctctacctcagcagccgtctccaccagtgccgccttcgtggcatactgcgacactctacaccgcaccctcaaattctgtcgaagtcccctcaagaacctcctcatctaggcctggtcatcctccatgccccgacccgcatacaccaagtgtcggttaaactcccggtcatactcccgaaccgaccgctcgccctgtgtcagctcaagaaaacgcgcctctatacggtcgagcgcctccttcggaaagtacttggcattaaactcagccacaaaatttgcccaagacatatctgcctgcctcctcctggcagtcacactccgccaccacaaatgtgcatccccctctagaaaatgcacttctagatccacccgatactctgttggacatctgctcgaaccgaagttccgctcaacccgcgacctccaactgtcggcctcctcgggactagtaccaccagaaaaacactcggtgccaatcctctgcaactactccttcatcctcaaataagatggaacctcctcagcaaccgcagccctctgctgcacctcccccactcgtggcgcaactcgagcctgcactggtaccacacctggtaaccgctccaactctggaacctaggctcttctggctgcggcacccatcactcctgggccctcagcaccaatggcatgcacaccggcaccgacaccagctccaccagcccacactccggctgcaccagctatatcgacaccaagactgtccctaaccccgggctccacaaacttaggctgcgaacccacactctgctcaagtgtggcactgtggccatcactctcgccggtaccctcgaggactcgtcccctaccgcgaccacgaccacgaactccagctcctctaaccatctgcgctactcaagaacaaatggctaagaaactaaaacaaacgaatatatcacaaacaacttaccgtggaatctcatttaaggctcgaagaagatgatgctaggactccaacaacccaaaattgactaaacactccataactaatcctcagtatgctaacaccctagctcatcccacatcaatcatcaggaaaataatttatcaattaattattctacacatcctagaaccgtgatcgttctgataccaaattgaaacaacccaacccatttttttaaaataaattaaatattcccataaatatctaattaaaccaaccaataaaataacaattaaaccgcaaatcaaaaataacattttatgaatcactaaataatttgaccaacaaaaccaagaataactaacaatcctaactgggttccaataaccaaaaacaccaaaaataaaacaaacgagttcctagatcatcctctcttccttgccatgattcaacgatcacactttatctttacctgcatcaacaacacaatgagatgcgtaagtattatcataaatacttagtgagtcgatcctcccatctacgagctatacacacaagcaaataaaagggtataatcacaaacacaatacaaacaaaccagtcattgaacaattcacccaaaacacattcaccacacctacatatcatcacacaaaacaaattacacaacccaatcgctcagataagctcatggtcacgcactcaccttaacaaattgattctaataacaattaaactcaggagagactctccttgcgtctgaaacagtccagaaacgtcgtacaacaagtcacaaccaaaagaaaccttgaagcaaactggacaagaaaaacagaaacaaacaacctcaaacacgaaaccctaaaatacaaagtaaccgttaactattaaatcgctccggtcaaacgttagccctagacgtcacgaagcttcccacaaaatatcgtcctgatcggaaaacagacgagaccacgatctcaatttcaatccccgctggtcctaattcgcgtctgagaaaacgtgtctcacgaaactgcgaataactcaaccaattgtaatccaaatcaagttctgtaaactggagaataacaataaacgacttggaaataactctacctaattttgttaccttttaccacgatttgatatgacgaaacagatttctcccaaaccctaacgattctgctcattctccttctctctctttttctcctttataaaacgaaaagtggctaactaaaaccctaatttcgagtttctttcttttatatgcacactatagggtttccaattaacccaaccaattaaaccggacgatttaaaaacaaaccctaaccgattttccggttcacgggcgttacaattgaaacaaaccctaaccgattatccggttcacgggcgttacatctgccgcatggaaatcatcgggatcactgtacacgctgtaatattagcatctttgagggcatccgtccggtagactatgtttcttccacgaggccttgaagttaagagaggtctgaggtaccaccaacatttgttagccatttttggctatcttggctagcaaatcgtcaggtatatttggtgtagacatatcttagaattacgtatttcaaaaataatgaaattcctactcttaaataaacaacaatgaatagtcgggtaagttatggttgtagataatgcaatcttaggtaactaataatgtagtgaaggattgtcatatcaactatattattaattggaaatcattgggaaactttacaacctttgaagagtagttttttataatgtctaagactaaatcaagtattcgtccatgggtatactggtcatttaacatattgaaaaaaacgcggaactatttcgaatccctgatctattatcgggccagtcgtattcaaagattggtacactggactatatgggccaatgattccaaatatgacccaataacacgacactcccctgcacgcaaataaatagcaactatttagattcaaaaactaatggcaatcaacaataaaatcttagctaaacgaatatattcttatcccataatatccgttttccaatgcaaaaatacagcaacaacaccacattcgaattcatattaacagatatttattctataacgcaatcaacaataaatcgtaactttcaaaagataccatatatatatctcttaactaattaacatttctgaatatctacatatcatatttaagctttccgaatatttcttgcctttgtacagaatatagattcatctcctaaactaattatcatttgacaatatactgacttaccaaaactaatccatttaattaaattgatccttttgcagaaagaatataccttatcataacttattcggtaatatcctaataaactgaaaaatattctctcaacctaacctaatgctccacgagattgatttagtaattagtataaatatatgcccaatattttcaagaacaatacactcaccttcaaaagttgaacaactgtttctcatcactcataattttttaaaaaattaattgataccaaattaatttatactaaattaggtttgattcactcaccttcaacgtttaccaaattaatcaaagattagtaacaagtttgattcctctcactataaattattgattgaggaaacaaatggtctaacatttctttgtctagctcttcttttgatttatttgtctagctcttctttgcattaggcaagcgttggtgttattaaatgagtaatgaagagaagaaatgatattgcagccaaatcgcatatgttaattttatgttactttattttctaatcaggttaactttgttttctaaaagttttcagtctaattaacttcagattaagtattatgaagttaacaatttcatatatacaacatttaggtttgttactgcttatcaaacaataggataatatagtttatggaagcaagcaatttattataatcaaaaccatcgacatacaatgataaaacaaagtgaactatgtttattcatcaaattcgaataggtgaagagtaggtacttagcaacttcaacagttaagaataacagtatatatatatatatatatatatatatatatatgtatatatttttagcaactaaacaaaggtattattgtacttaacatcaaactaatctttttcatttagctttctgtgaagttccaaagactaatctttttcatttaacattcttagaaacaagtgacgatgtataatttaggtgaggaaaacttttcaagtcaaaggaatctttacatttagaattctggaaatctccaaggtgaacatctaagccttctatcgtgtttcgagtagcttattatcaagaaattttagttcggaacacgggaaattgtagcacataatgattttgttagctgtagtgttaaaagaaaacgaaatcaaatccgtctcatttgatctacgactatatatagatttcaaaataattacccatagcagatcctgttttttgacaattcttggggacgatctattatcaaacaaattatttcaaagattataaatttaatcgacagatttgaaaacaaaaaaaactaatatatgatgcaacaaaaaacatacttctttatagaactaaatctgtaaagtatatacaaagtataacagagactaaaataggtggattatctgtgaattttgctacagatttgtcgatcgaccgacaatgttcaacaatttgggtttgcaccaaaagacaacgtgtcttcaaacaataatttaattatctgtccaaaataagaaaaacataattcattacaaacataattcattactaaatcaattacaaaacattattcggcccaatatataaatgtttttcggcccataccaaaatatcccaaacctgttattgcttggcttgactctgtaaactctgattgcatcttgattgctagcatcacacccatttagattgacaacataaaatactacaacgacaggatagtgttttaggattaattgactaaaaacctattatcaatttggcgccgttgtcaattgggtgtttgtttgttatatttaagatttcagacttgcttacatcaagttctttttcaattttcacttcaagtactaactgtgtgtttttcttgttgtcttcttgatccaggtacacctctcctgtatgcgaactcgatcaaccggcaaccataacctgcttttcaacgataacattgatcgcatagctcgcgaactaagagaaaggagaaacatagtcgaccttgtacaacaccaacaaccacttgaaatggctgatgaacaaaatcaacaaaatggacctgcgaacattggtgctagagatgcactaagggatcaccgtttgaggatgggaattgcacctcctgctatccagaacaacaacttcgagattaagagaggtctcatctcgatgattcaggggaacaagttccatggtctgcctatggatcaaatcgaccatttggatgaatttaataggctctatcacctaaccaaaatcaacggtgtcagtgatgaccgattcaatctccggttgtttccattctccttgggcgacaaagcacacatctgaaaaaagaatttgccccatgactcaatcaccacctgggatgattgcaagaaggcctttcaggcaaagtttttctccaacgccagaactgcaagactcagaaatgagatttctggtttttcacagaagactggtgaaagcttctgtgaagcatgggagcgtttcaagggttataccaaccaatgccctcatcatggcttcaagaaagcctctctgctcggcactctatatagacgtgttctaccatggatcataatgcttctggatactacaagcaatgggaatttccagaataaaaatgttcaagaagactgggaattggttcagaatttagctcagtcagatggaaattacaacgaggactgcgacaggaccatcagaggaacaatcgactttgatgacaaacataggaaggagaataaagctctgaatgacaagctggataggattcttcttagccagcagaagcatgtgcacttccttgttgatgatgagcagtatcaggtccaagatggggaggggaaccagttagaagaagttagctacatcaacaatcaaggtggctacaaagggtacaacaacttcaagactaacaaccccaacctctcttaccgaggcaccaatgttgctaatccataggatcaagtgtatcctccacaacaagtgcatggtgagagcaaaccctttgttccctacaaccaaggctttgctcctaagcagccatttcagaagaactaccagccgcaaccaccacttgggtttgcacctcggcaacaccaaggtccttctgctcttgatactgacatgaaacaaatgctacaacagctactccaaggacaagcatctggctccatggagattgttaagaagatatctgaattacacaataagctggactgtagctacaatgatataaatgtcaaggtggagacactgaattccaaagtccgatccttggagggatattctacatctacttccgctcagaaacagacaagccaacttccaagaaaagcgattcagaatccaaaagattatgctgatgctcatggtatcacccatcataatggaaaagcacttccaatcagagaggaacctaaaacagtcactgaggacagtgaagataatgatggggaggatatcagtctcagtaaagatcaagtcgaaaaacaactcgagcaggcactcgaccagtcacttgaccaaccactcgagcatccactagaccacgttactcgaccaccattcccactaacatcaccaactgctccaaaactagtttctctcacgaacaaagaaaaggtctttgttcctcctccttacaaaccccatcttccatttcctggccgtcacaagaaagcactggcaaataagtatagagctatgtttgccaagaacatcaaggaagtagagttaaggatacctcttgtcgacgctctagcacttatcccggattcccacaagtttctgaaagacttgatcgtggagagaattcaagaagtgcaacggatggtagtattgagtcacgaatgcagtgcgattatacagaagaagatcattctaaagaagcttagtgatcctggttcattcactctaccatgctctttagatccattggctttcaacagatgcctatgtgatttaagagcaccagtcagtctcatgccactctccgttgccaaaagattggggctcactcaatagaaatcttgcaacatatcccttatcttagctgacagatcagtaaggatccctcatggtttacttgaaaacctaccaatcaggattggagctgtagagataccacagactttgtagtcctagaaatggatgaagagcccaaagaccctttgattttgggaagatcgttcttagcaactgcaggagctattattgatgtcaagaaagggaagatcgatctaaaccttggcaaagattttaggatgacctttgacgtcaaagatgcaatgaagaagcctactatagaagggcaactcttttggatcgaagagatggatcagttagctgaagagttactggaagagcttgcagaagaagatcaccttaatagtgctttgaccaagaattgtgaagatggatttctgcatttggagactttgggctactagaagctgttagattcacataaagtgatggaagaatcagaaccctttgaagaattgaatggggcagcaatagaggtaatggttatgaatgaagaatagtcaacaaaggttcaacctgctcacttgaagacatactcgaccagtcactcgaccgcatctatcagtgacactatggagctgatcattctaacttcagatgactggtctgtacttaaagcaccgaaggttgatctcaaaccacttcctcaaggtctgcggtacaaattccttggttcaaactctacttaccctatgatcgttaatgctgagttaaatgatgatgaagtgaacctgatgttgtctgaacttaaaaagtatagaagagcaattggttattcattatctgacattaagggaatttcagctagttatgcaattataggatccatcttgaaaacgaatcttattctagtattgaaccacaaaggaggttaaatcctaatttgaaagaagtagtgaaaaaagaaaatttgaaactgcttgatgttggtgccatataccatatttctgatagtacttgggtttctccagtgcatgcgtccctaaaaaaggtggaatgactgttgttaaaaatgaaaaggatgaattgatcccgactagaactataactgggtatagatgtgtattgattatagaaagctaaatactgcatctaggaaagattattttcctttaccattcattgatcaaatgcttgaactcttagctaatcacccatactattaatttcttgactgatatagtagtttctttcaaatactaattcaccctaatgatcaagagaaaactactttcacatgtgcttatggaatttttgcctataagagaatgccatttggtttatgcaatgctcctgcaacgtttcagaggtgtatgacctctatattttcggatttaatcgaggagatggtggaggtcttcatggataatgttttggtctatggcctctccttctcctcatgtttgttgaatcttagcagggtattgaccaggtgcgaagagactaatcttgttctcaattgggaaaagtgtcatttcatggtgaaggaaggcatagtgttgggtcacaagatatcagagaagggtatagaggttaagaagggaaaaatcaaagtgatgatgcagttgcagccaccagaaactgtcaaagacatcagaagtttctttggtcatgctgagttctacaggatatttattaaagatttctccaagatagacaggccgttaactagactattgtgcaaggggaccaagttagaattctatgagaatttcctcaaatcctttcacaccgtcaagcaagctttggtatctgctcctgttgttcgagctcataattgggactatttgttcgagattatgtgtgatacatcggattacgtcgtaggagctgtactaggccagagaatagacaaggagcttcacgttatatattacgccaacttgacgttggatgaagctcaaggaagatatgcaacaactgagaaggagcttctagctgttgtattcacatttgagaagttcagaagctatttgattggatccaaggtcattgtctatacagaccatgcagctttaaagcatctgtatgccaagaaggatactaaaccaagactgttgaggtggatacttctgctacaagagtttgaaatggaaatagtagataagaaagggattgaaaatggtgcagctgaccatctgtcaattgaagaacctattccgatagacgacttaatgccaaaagagcaactcatggttataaaattctttggtggtagttactgcgggaaagagttccaccaactgaatgctgttgagggaagatctccgtggtatgctgatcacgtcaattatttggcatgcggagtagagcctcccaacttgaccagttatgaaaagaaaaagtttttcagtgacatacaccattactactgggatgagccttacctctacaccctctccaaagataagatcttacaggagatgcatctcagaagatgaggtagaaggtatcctgctacattggcacggctccgcctttggtggccactttgcgatattcaagacagtgtcaaagattctgcaagcaggcttttcgtgaccaacaatgtttaaggacgctcatgagtttgtcttaaaatgtgattcatgctagaggaagggcaacatcagcacgaggaatgagatgcctcagaacccaatcttggaagtggagatctttgatgtatgggaaatctattttatgggtccattcccatcttcatatggtaacaagtatattctggtagccgtagattacgtatcaaagtgggtcgaagctattgccagtcctactaacgatgcaaaagttgtgttgaagctgttcaaaaccataatcttcccgagatttggagttccaagggtagtaatcagtgaaggtggaaagcatttcatcaacaaggtttttgagaacctcctaaagaaacatggagtaagacataaggtcgccactccttatcatccacagacaagcgggaaggtggaaatctccaacaggaatataaaaacgattctagaaaagattgttcggattacaaggaaagactggtctgcaaagctcgatgacgcactgtgggcttacaggactgccttcaagacccccattggtacgactcccttcaatcttctctatggaaaatcctgtcacctacctgttgagctcgagtacaattatatgtgggcggttaaactactgaactttgacataaaaaccgcttaggagaagcggttgatccaacttaatgaccttgatgagatctgtttagaagcttatgagagctctaagatatacaaggagaggaccaagcttttccatgacaagaagatcatcaccaaggatctccaggttggtgatcaggtgttgctatacaactctcgcctgaaactctttccaggaaagtttaagtctagatggtttggtcccttctgtgttattgaagtccgcccttattaagcagtcactctagctggtaagagtggagatttcacagtgaatggtcaaaggctcaagaaatacttagcagatcaaatccttctagaggtgactttggctcatctccaggaacctcttgatgattaaaggagtaaggaagtcaagctaatgacttaaaacaagatcacttggggggggaagtcccatgcctttctttgaactattcactcgaccacatttatcagcgacactatggagctgatcattccaacttcagatgactggtctgaactcaaagcaccgaaggttgatctcaaaccacttcctcaaggtctgaggtatgcattccttggttcaaactctacttaccctgtgatcattaatgctgagttaaatgatgatgaagtgaacctgctgttgtctgaacttaaaaagtatagaagagcaattggttattcattatctgacattaagggaatttcacctagtttatgcaattataggatccatcttgaaaacaaatcctattctagcattgaagcacagaggaggttaaatcctaacttgaaaaaagtagtgaaaaataaattttgaaactgcttgatgctggtgtcatataccctatttctgatggtacttgggtttttctagtgcatgcgtccctaaaaaaggtggaatgactgttgttaaaaatgaaaaggatgaattgatcccgactataactctttccagggaagcttaagtctagatggctggtcccttctatatcactgaagtccgcccttattgagcagtcactctagctggtaagagtggagatttcacattgaatggtcaaaggctcaagaaatacttagcagatcaaatccttcctgaggtgacttcggctcatctccaggaacctcttgatgattaaaggagtaaggaagtcaagctaatgacttaaaacaagctcacttgggggagggggggggggtttaagtcccatgcctttctctgtacatatttttgttttccttgtaatttttgatgcattttactagtggtttcaggagataactgctaatgtttaagtgcaatggattcaacctcaaaaattcacttgaccacatgatgtagagatcgagtgtctctgtgcaatcgagtataaacaaggtttcagttggagcttcaacatgtcactcgatcacactggccacatgctgatgaggaaatataatcgagtaaacttgatgattctgagcctttatactcgacctcgtactcgaccgtaataagccatatggcgaccagcggtggaaatcgagtgtgttgttgttttgacccaaaaattcaaccttatactcgaccaatagaggctacagagacttacagaggattttaggatttcctgaggttttgcagtcaacagggaactgagcttaatgacaaaacaacatagcgtggaccacacgcgttttctcactgaggataagatggagagagaaatacaaatttaatctccaccattccttttgaaatcgccttcattccttcaaaacactaaagaaatttactcgacctctgaggaaaataaacacttcgccgcctctcaagttcaccatctccaagactcgatttcaacaagattactcgactgctgcggaagagaagtatttcaccgtcgcaatcgagtacgccgactcgtccttggtcgagtagcaccagttttaaccccatcgaaagcacattcatcccctctggaatctaagtaacttcgaagagtcactcgacagccgctacgccgccgcaatcgagttcaccatcttattcaccatcgagtagaatcagtttggccgtcgaaacctcaagaacactagaccagattcaagattccaaacgataattccggttgactgagagtttactcgatcgctggtgctctcatttagcagatccactcgacatcaccagttttactcgaccaccactctatgcaacttgattccaatcatgaaagaagagcttgtgaacacgtcagcttactcgagtactgggttacactcgaccagtttagtcctttttgttaattcttgagaacaattccggtttcatagttttttttgagactaacctattgacatttgagttttgagttctcaatctttttcaggatcattatgagcaactatagtggcggttcgtcaattgattccgactataacttggatgaggctgagttttcatctttaagaccggaaagagaacagagggaatatgagaatttcaggagaagagctgagatagctctagggaagagagcagtgacagagaggtatgagctgatagacgaggagatggaggtcgagtatatgcctgagcattctcatagagccacaaaacctctacacaagcctgggttattgccagctgaggagtatatcagactcttcaagctgaatgagttctacaacacaaagtatccctgctcaactaccctagcacagcttggattactggaggatttcagcacatgtaccagagttgtcacctggacactctgatggcttacccatatgtagcctacgaggaagaaacaattcagttcctttccacactacaagtggagctccaccaaggtatgacctttaatgatttggaaagtgaaggattgggattcttgagattctctgtgtatggtcaggattatatgatgtcaatcaagcgtttggaaggattgtttggtttcccagtggaacgggaaccaagcccaagtatgacagagatgagtggaaggatttatggatcaccattggcagctctgtaccactaaattcttctagatccaagagcaaccagatatgcaatcctttcatcaggtacttccagcgttctgtggccaatgtcctctactctagagagataacagggactgtcaccaactttgatatggagatgatcactatggctctcagaagtactctccgccaaaccaagaacggtatttctctccaaggtgaaatcaatgacactcctctctctatacttcttctgatccacatgtgtggatataagagctgggctaccagcaataaccacaagagagcacgaggcgctctttgcagatgaggggttctgacaccaattcttatcgcttgtggagtcccaatcacatctgatggacttgagccacgagcaatggatctcgagcatctacgacactacgaaatcctcgagttggaaatggtcgacgacaggcatcgtttcaagtttgagcactttacaaacaagaaagccaacatccttccccccagtcctaagcttagacgcataatagagggagataacatttatttcacacctgcgcttgagaacctctattacaagaacgcttagctgatagatgaggatgcaagacggtactgaggatgagatcggtgagacggatgaggagaagtatgattcaagcatgtatcatttcagtgagcacgtagctctagcgagggagagtaagagcttgagtgaagctcacagaaacaatagcaagttgcagaagtggtgcaagaagcaagacaagttcattatcaaatgcctaaagactatcaagtctttgaaggccatgctaagctgctccacttccactacaactattctgcagggacagcctcctcaggacatgccattgaggagatttgacgagcttgagccgagtcaacacaggcctgagcctagtgagcagagggtctcacatttcccagctacacattcatcattcgagtctcgggagcacatgaagaagaagaaggctatgctcgttcgctctagcagcagatcatgccttatcaactcgaggagatcactcgaccgccatgctggccgcaaaagaagaagagaggtcgagtatccttgtggcggtgctggccgcagaagaggcgatgaggtcaagtatcctcagggagttggggctgagacagaacagggcgacactttcattgcttgggagcaatcacaggcagccattgatgaccaactctgttcatacttcgacagaggtaagcacctgacttcaccattgtactataccatctcgtgtttttattttgtttttgtgatgtgttttgtcctgagtactctcttccaagtttagtaacacaaaggattgtttgatttaagctagattactatactcgatcacactgtcatgatttgataccattccctatcaatttgaacctgaatctgattttttaattatcatgtctgtatcaaatttcaactcatggataccctaaaatacatggattttcttattcattttaaccactaataataggtttttagtcaattaatcctaaaacactatcctgtcgtcctagtattttaggttgtcaatccaaatgggtgtgatgctagtaatcaagatgcaatcagagttcacatagtcaaggcaagcaataacaggtttggagtttctagcagtcctaaatgaacatgcaggaaacagaaattcaagtagaaacagttaaaacactcgaccaacacagcatgttgccaagcactaggtgtggtcgagtgacaagtcgagtaaatagcagagacagtaacaaagatactcgactgcacagtctgttacacgacaattgggtgtagtcgagtatatgaatgataacatctttaaaatgcaaaagctaagcgaggagtaagcaatgacagagtaaacaaagaaatcaattagatgagaaattcccgaggattgggtaatagaatagttagtttcctcagtctacaggtgattgacatgctcaataaaatatccctagacaacaagttcgataaccaaatctaagtgccaccgcaacagagatcctcaagttaaagtattcccagaatcaatcaccatttacgagagctaacctaacaggcattacgaatcaacaagttaaagccaaaacgctccctgtaaccaataccttggtacagagccacgaatctctagaagtagtggttcagacattttatcgaacacttatatggtgcggaaatgtctgggctcaaatttcaattgatcagaaagcaataggcattaagaacaactattccagaagggactatatatcaaactcaaccagctaacagaccgaggattctaaactactctatcccatcttcagaaacctagtcactactcagacttcatttcagaaaacataaacgatgacatgaatgaaaacatcatagcaacaaagtaataacaaaatgatacaacatgaactacttagtaaacgaaatgtaaagcaaatattgaatagattaagagaaatccggattacaaaatgtcaagaacacaagttacttatagcaaaatgttctgaaaccctaatactcaaatgacatcaagtggtagtgatcgagtggatggggagaagtagagatggtaatgctcgaccaaggggtcgagtggtggtgagaagtggtgatgccttttactcgaccctggtcgagtatcgtgaacgagagtgttgcggtcgagtgactagctgcggaggtcatgaccaagcacttcaagaagaccaggatggcggtactcgagctcgtggtcgactatgttgatttgatcaggtccacttcttccaattagcttaaagaagctccaaatcaccttaaaacaacataaatatgcaatatgcatgcaaaactatcctaaacatgcaaagtgatgacaaatgatgagaaatggtataaaacagtggtgatatgatgataaagtgatgacaaatggatgctcaacacatgtaaaattcacacttatctaccactcttgttagtccatataaaacagtggtgatatgatgataagtgtgcattttacatgttttgagcatccatttgtcatcactttatcatcatatcaccactgttttataccatttctcatcatttgtcatcactttgcatgttaaggatagttttgcatgcatattgcatatttatgttgttttgaggtgatttggagctgctggtgaggtaattggaagaagtggacctaatcaaatcaacatactcgaccacaagctcgagtaccgtcatcctagtcttcttgaagtgtgcattttacatgttttgagcatccatttgtcttagcatcatatcatcactgttttatatcatttctcatcatttgtcatcactttgcacgtttaggatagttttgcatgcatgttacatatttgtgttgtttccaggtgatttagagctgttgggcgagctaattggaagaagcggacctgatcacagcagaacactcgacccattggtcgagtagatggctccacatctttaacaaaccactcgacccggtcgagtagaagaactcatcacttcacgtcaccactcgaccccctggtcgagtaccaccatgagagtcacacgatcacaccactcgaccccctggtcgagtatcatcacctcaatacctaaccatcactcaatcacaccactcgaccaattggtcgagtaactccatcacgttcactcgatcactctaccttcaagccgggtatcaccatctctataacttgactgcatactcgactgcaagctccagagtcttctccattccgcactcaaccagacactcgagcacaaggaagaaaagaagactccagcttatcactcgaccattcactcaaccacctgggtcgagtaccgttcttaatccgtcccaatactgggtcgttttgagtattaggattacgcaatattttgctataagtagcatgtattttacatttttgtaaaatctaagttttattccgcagacactgtgttcttgacattttgtaatcctcatttctcttaatctattcagtattcagtatttgcttttcaatatcatttactaagttgttcatcttgttatcatcttgctattactctgttgctattatgttttcattatgttcatcgtttatgtcttctacaatgatgtgtgagtagtgaataggtttctgaggatgggttagagtagtttagaattctcagtatgctaggtggttgagtttgatttatagatcctttctggattagttgttcttaatgcctattgctttctgatcaactagaatttgagctcagacatttccgcgcccaaaaggtgttcgatgaaatgtctgaaccactaattccagagattcttggctctgtaccaaggtattggttttagggagcgttttggctttaacttgtttgattcgtaatgcctgttaggttagctctcgtcaatggtgattgagtctgggacaagtttaacttgagggtctctgttgcagtggcacttagatttggttaccgaacttgttggctagggataatttattgagcatgtcaattacctgtaaactgaggaaacgaaactactcaattaccccatcctcgggaattctttatctgattgatttctttgtttactctactgttgtttactgcatcttattacctgttgtttagtttttgcatttctctcttgttactcgacctgatactcgaccacttagttgtctgactgtgcagtcgagtatctctgttacattttctatctgttactcgatttgtcattcgatcacacccagtgcttggcaacaagctgtgttggtcgagtgtttctactgttctgcttaaatttctgtctcctgcatcttcacttaggactgctagaacacaccaaaacctgttattgcttggcttgaccctctgtgaactttgattgcatcttaattgctagcatcacactcatttcgattgacaaccttcagtactacaacgagattattggtgttttaggataattgaaaaaagacatattatcaatttggcgccgttgtcattgggtttttgtttgttacatttgagatttcagacttgcatagaccaagttctttttcaatttttatttctgttactgactttgtgattttcttgttgtcttcttgatccaggtacacctctactgtatgcaaacttgatcaacatgcaaccagaaccttcttttcaacgataacattgaccgcatcgctcgcgaactcagagaaaggagaaacacagtcaaccttttaccccagaaatcactcaaaatggctgacaaacaaaatcaacagaatggccctgcaaatattggtgttggagatgcaccaaggaaccaccgtcagaggaaaggaattgcacctcctgctatccagaacaacaacttcgagatcaagagtggtctcatctcgatgattctggggaactcgaccacttggatgaatttgatagactctgcaacctaacaaaaatcaatgatgtcagtgaaaacggattcaagctccggttgtttccattctccttgggcgacaatgcacacatctgggaaaataatctgttccatgactcaatcaccacctgggatgattgcaagaaggcttttctagcaaagttcttctccaacgccagaactgcaagactcagaaatgagatttctggtttttcacagaagactggtgaaagcttctgtgaagcatgggagcgtttcaaaggctacaccaaccaatgccctcatcatggcttcaagaaagcctctctgctcagcactctttacagaggagttctaccacggatcagaatgcttctggataccgccagcaatggtaatttccacaacaaagatgttaaagaaggctgggaattggttgagaacctagctcagtcagatggaaattacaatgaggactgcgacagaaccatcagaggcacaactgattatgatgataaacacaggaaggagatcaaagcgctgaatgacaagctggacaaaattcttcttagccagcagaggcatgtgcacttccttgttgatgacgaccagtatcaagtccaagatggggaggggaaccagttagaagaagttagctacatcaacaaccaaggtggctacaaagggtacaacaacttcaagacgaacaaccccaacctctcttatcgcagcaccaacgttgttaatcttcaggatcaagtgtaccctccatagcaacaacaaggcccaaacaaaccttttgttccctacaatcaaggttttgttcccaagcaacaatttcaggggaactaccagcaaccaccaccacctgggtttgctcctcatcaacaccaaagtcctgctgctcctgaagctaaatgaaacagatggtacaacagttgctacaaggacaagcatctagctccatggaaattgcaaagatgttatctgaattgcaccataagctggactgtagctacaatgacctgaatgccaaagtggaggcattgaatacaaaagtcagatacttggaggaacaatccgcatctacctctgctcccaaagttacaggacttccaaggaagtccatacaaaatctaaaggagtatgcaactgctcacgccatcactatccgccaggatcgagagctgccaactcgacctgttcctaacttaatcactggggacaatgatgttcaagaaggggagccctctactcagattgatgtctctgttgttgaattcaaccattctgttggttctcgccatcacattcaatccacctcagaagaaaaagcatctataattgagagaatggtaaaacgtttcaaacctactccattaccctcacgtgctcttccatggaaattcaagaaagcctggatggagagatacaaatctgtttcagagaaacaacttgacgagattgaagcagtgatgccactgatggaagttctcaacctgattcctcaccctcacaaagatgtgagaaatctgatactgtaaaggatcaagatgtatcatgattcagatgatgattgtgatgctaatccgtctcgagctgctgataagaggattgttcaagaaaagttagaagatcctggatcttttactctaccatgttccattggggaattagctttcagtaattgcctgtgcgatctcggagcctttgtcagtttaatgccactctctatggcaaggaggctggaattcatttagtataggccttgtgacctgactttgatccttgtagataggtcttcaagaaaaccctttcgcatgctaaaagatttacccatcatggttaatggagtggaagtgcctacagacttcgttgtgctggatatggaagaagagcataaggatcctctaatcctgaaagacctttcttagcctcagtgggagcagtgatagatgtcaggaagggaaaataaatctcaaccttggaaagcatatcaagcttcagtttgacatcaacaaaactccacaaaggttaacagaagatggaaagacctctgaagacaatagagtgattgcaggagaaggatatgagactgaaagagtaaaagagcttaaaaagaggtctgataagcaagagaaaactatagaggagctagcccacactgttgaggaacttaagagtaagctggatcagatgtagaaagaagcctaacctaaaggcgggattgacacttccgagaaaaaagttcacttcaagatggtctgaagagatagattaccctctagaagacaaagaagcctattttggagaaaggcgaattgagtaatttgctgcacacctctccagagaggacgctaagtatgatgatgatattagagaggattatgcagaccctctctatcattaattttcttcttgataagtgtgaggagtcacgcaagagactttaaacaagctcacttgggaggaagtcccatgagtatctctgtgaataaatttttcttttcttggtattttggatttgttttcgttgtgtttgttgttctcaggaatagaggaataacttgaaggaagagtgaaaattcaaaactcttactctacagacggcctagagatcaattacacagtatagtggattgcaaatttttttaaaactttcaattgcacttggagaccttgcactcgagtatattggtcgaatatgagtgatgtttaaaacccataaatttttaaatcatcattttactcgaccaacagaagctacaaagtcttatagggagtttatcaagtttacaaaggattgcgggatttcctgaggtttttcctgtaaacagagagcacagaagaaagacaagaagccatagtgggacccaccactgacgcccatgtcctccatgcagcagaccaagagacatggaatctcttcacacccatctctccactcgatcactacgcaaccttatcctcaccttcactactcgacttcatctctcaactcgaccactccagcttctctccccataaaaacactcgacttcaatcgatatcatcatcctcacaaccttcactcgatcacgtcaccatctctcttcatatactcgaccgctgaacaaatatcaccttcaagctcatcatctctctatcgcttccaacgccactgctctcttccccacgaaagctcatcacatcgcctcttcaacccactcgacgtcgcgcattcactcgatctctcatcaccatcttcatcacatcgccacttctcaccttatctcgccaccaacaacactcgactgcagctccctcatagcctcatcgttttccaccgctttgttccagtcactcgaccaactgccaccgttttctcttctcaccgaaacaatcactcgacttctccactgctcctcaccgctcaagctccattagttcactcgaccatcatctcattctcaaatcaactcgctcccgaatcaaaagagaagaagaaggaagacgccaccatcaacaaccgattcactcgaccgccgtttcactctatctcacaaccacgaaactagcttcactcgacctcacaagatcactcgacctcgtctcactcttcactagcaacactcgatcgcgtatcaccaatgaatcccacaagaagtctcgcctctcaacctcactcgatcgcggagaacactccattcactcactcaaggaatcactcgatcaacaattcaccaaaccaaaaaaaaaaaacggtttacttgaccagtttacttgaccggtatactcgattggtttgtgttttggttttgttgggactaacgtattaacatttttctttgtgttccatctaatttcaggtttcgtcatgagaaactaaagtagggaatcctctgtggatcctgaatataatgtagatgaagctgagtcttggtcaactagaccagagagagaagaacacatttacgaaagcttcaggatagaaatagaacgctcgatagctgaaatcgctagaggaaagagagcgatgtcgagtagatatgagttgattgatgaggacatcgaaactgagtatgagccagagtcatggcgcaaggagacaaagctgttgaacaaacctgacgaggttacagtggaggagtatatcagattctttgagctgaacgatttttggggaatgagctatccctgctatgagaatttagcccagctggggttacttgaggacgtgcagcatctgttcgtgaagtgtcatctggagacactcatgtcttacccatacgctgcctacaaggaggagacgatcaagtttctctccacaatgcaagtggagatgtatcagggtctcacagaatttgagctagacaccatgagattgggattcttgacattttcagtggatgagcagcgctatcagttgtcgatcaagaagttgaaagaactgtttggtttccatagtggaaagggaaccaagcccaagtttgacagggagactttaaggatttgtgggctactattgggaacaatgtaccgctaaactctgcccggtccaagagcaaccaaatctggagtccattgattcgctactttcagtgctaagtagccaatgttctttactccagggagtctacagacatcgtgtctaacacagacatggatgtgatagattccgcacttacaagcattctccaccgtacaaagggaaagaaggtcctgagaggtgatctcaatgacgcgccaccagtaatgcttctgttgatccacctgtgtggatacaggaaatgggcgttgacaaactgcaagaagaaagtgagaggaacactatgcgtaggtggcgttgtgacgccgattctcgaagcttgtggagtaccgctcaagaaacaggggttagagccgagaatgatagatttggatcatttacgccgatgtgagttcttggagcatgacatggttggcaacttccacagctacaggttcaagcattcatcgatcagaatcgccaacatttttctcccctacattgacgctaccaggattctcgagggcaggaatattgacttctagcctacgcttgaagatctttatttcaagggcagtccgccaactgaggagatcagtcacacggaaggagctacaatagaagaagttgatgagacagatgaaatagatgaagcggagtttgacacgagcatgtctcatttcagtgagcatgtacctccagcgagggaaagcaagagtttgagtgaagctcacaggaacaacaacaagttgcagaagtggtgtaagaaacatgataagttacttgccaagtgcctcaaagctatcaagtttctgaaggacaagctaagctgctcctctaccactacagctattccgcatggacagctccctcaggacatgccctcgaggagatatgatgcgcctgagacaagtcggcgcaggcctgagcctactgagcaagagattatgcatgtccctgcgaggcattcatcattcgagcctcgtgaatttgggagaaagaggaggaccaaacttactcgatctagcagcaggaacagacgacttctgcaatctcgtagtttacgcgaccgcggtagaagaagagaggtcgagtatcctcaagcggtgctggccgccacagagctgatgagatcgagtacccacatgctagagctgatacagaacagggcgattcttctatggcctcggagcaatcacatgcaaccattgacgaccaacttcgttcattcttcgactgaggtaagcgcctcacttctccattgtattatatcatctcttgtgatttgttctttattttgtttctgtgatttgatttgtcctgagtactctcttccaagtttagtcacacagtggactgtgtgatttaagtttgggggagggctcaggaagtgtgtgttgcattcttattcattttgatcactcttgttaatccaagtaactgactctcgttattagatcagttaacccgaacccaaacataaactttctttcaagccctatatcacttgtgagtgtttgtgaggttttattccgatttagattggtagaaagtgttaggtttgtaacgacagagatagtgtctcatgtagttctacatcgcattttctggactagataggactaggtaagcgcttatactttgggttgggatgtgtctaaaaaaaaaaaagggttgattcattgataaaaaaggtaaaagactctaggtgaagtaagctaaagaagcagaaaaagtctaataaatgttttgggatttgtaaagaaaagagttcttgttagctaatgaagaagggcaaaagcccttaattttaaattttaaaaacaggaacccttagttgttaaagaaatccaaattcgctagatgtatcagtgttgagaaagcttctcctagagttaagagaaaagaaaagaatgattagaaaaatgtcttaaaagattcatgaatgcaaagagtagagttaagttcttatattgggattggagatgggattaccattagagcttcatttgttatactctgggtagatgggatcttatctctgtatgcatagcttcggacttacctttagcattctactaaagcttaatcattttttagagatcccctgttactgaagcctattctgtaagggatcatctttgtctcttgacctttaccttaaccaaatgagttcattgatgatgcattgcttgattcacgttctagaactaatgaatgttaaagagattggtagatttgaaaacatgtgtaggtagagcataagagtcggattgattgataacaaggcatggctaacgttttaagtagaattcgatcatatcgcagcttagaactaccaacttgaacattgatttcatctaatttatctggtgctttggctctgagtctccgctttcaaacctcacctccagcttgttcttaattgtttgctttatggcaagcaaatactaaatttgggggagttgataagtgtgcattttacatgttttggaacactccgagccatctccattagtgttctattacatctttcaaccacaccgttctgttgtggtgtgtagggtgccgtgagatgcccttgtataccaacatctttgcaaaaactattgaaatcttgtgataagaactcttttcctctatcagttttaaatgtttttatggtaacttctaagtctttttccaccgattgtttaaatttcttgaacctctcaaaggcttctcccatttctttcaatagtattgtccacatatatcgagagtgatcatatatgaggacaaagacgtacttatttccagctgtagtactcggtgttgtaggaccacaaaggtctaagtgaattaactctagaacttgagttgttcgatataacgttgcttgcgggaatactctccaagtttgctttccgagtaagcacgagatgcatatttccttttgtatctcgacacatgatactccattaacaagctttctttgtatcattgactttattgtatcgaaatttatatgccccattctagcatgctacctgctactctcgcttatctttgaaaggtttagagatgcagccgtattcatcatcctcatatgcactttgtaaagccgatctcttgatctgtcttctttgacgagaagtttaccctcgtaatcgtgcattgttaagtgatctcctctcattcttatgtcacaccctgattctgtagcctgtcccaaactgataatgttactcttcaagtcatgatcatgatccttgctttaccattgatatcaatgaacgagattgagccctttcccttaatatcaatgcatgagtcatcaccaaatctgacctttcctgtgatagagctatcaattttattgaagtatcttcgatcccctatcatgtggttgctatctccattatcaaggtaacaaatgtactcatccactgtgttcttctcatacttgctcggcacgcaattcttttcattcaagtacactacttcatgcatcataaggtcatcggcttctcgggtgtcactgttctctgtttctagagcttcttgcaacttaagtaattagtcaggacaattagaggcgtagtgacctaacttatcacatcgataacacgttacttttgatgtatctcttccaccattgttaaaacgtcctccacaacctctacctctgttccgtcctctgcgacctcttcctctgttgtattcttgattcgattgataatcctggtttgagtatagaagcttgccttgatcttcttgcggttcttcttcttctatgactcactcttcataaactttcagtcgtcctaaaatatcctcgaacatgttagtgttaagattgatggaactatgtgaatgaatttttttcgaggaagactcttaagaaatttcttcactagttttgtgatagactcaggattcccctagcttgtatgagaagaagactgagagctggagggaagaaggcaagagtctgggagaagcttctgaagaagatactcaagagtggctagagtgcacaagagacactgaaggagaaagagggttcactttaatattgttgtcttttaattcaagtgttgcgttttatgtaagggttttgatacactctgtatttaaaggagggtttcccgtttagggcctcctcaatcattacctaccaaaaacattactattttctaatctctctctctttcctctcggccgcatctggcgcaatactatctccctcctatttcttcttgttacactctcgagttaactgtcaagtttatcattggtgctttcagttgttagagtcccccataaacacaatggccgccggtgaagattctcagtcaggatcaccagaaccaagtaaccctcccgctgcaaccttaccgccgctggataacagagtagaaatggtggaaaaagagctcctttacataagggaagctttaacccagatcttaaggaaccagatctttggtccacctcgtgaaggtcaaggaaacttaccagctgcgttcgctagtccttctcctggcccagctttccaagcgacaccacctccaaactccgagcgtggaaacagagaggctattctgcctttcccgactccagaacctgcaaatgagacaagtggagactcgtttcctaccgccagcgttggaacaacagggttattcaccgagacagaggcacgaggctccggtgagacccctcgagctaccgctgtacaaaggagaaaacctagatgactggattttccgcgtggagcagtgtttcttaactcataacacaccagaagacatcaagctcgaaaaggtgatatcttgtttgactggtccagctgtaacgtggtggagatgtgctaaagaaagagaagggatttacacatggaaggacttccaagacaagtttaaaataaggttcagaccgagcagaggaagctcagtggtggatcacttgctgaacattagacagacaagcactgtcgatgagtatcgaggcagattcgaagagcttttggtggagttgcctcatgtccctattgacatagtggagtcagcgttcttgaatggattgaagagaagtcttaaagaccaggtggtcagatgtcgtcctgtcaacttgaatgacattgtggagatagcaagacttattgaagcacaggagaggactaaccaaagttatcaagttagaccccaacagagaccatcgttctcagctagccaaacgccatccggatccagagcaatggagaggacgcagtctaaacgtccatatgatcccagtaacgacctgaaccgtgcttcaggaagtggagaaccaaagaacaccaatccctgcaggaactgtggcgatagatggttccctggccatcactgcaagcagcaaaggttgaaaagtttggtaactgctggtgaagaggaccaggaagacccacctgaagaagaatatgtagagcagaatgatgaagaagagcaagctgaagaagaaaccttggcgactcatacattgggatcactatttgatgttgaaagagaaaggtctatgaagctcaaaggctatgtgggaagagctaaagtggtggtgttggtagattcgggcgctactagtaactttatagatgagagcttggttcatgaaaggggctggccgagtactgagactagagggttctgcgttaaagtgggaggaggtagagtgattaaaggcagaggcatgtgtgttaaggtacctctggagattcaaggtatcgaatcatggaggatttcctgctctttgacttgggagatctagacatagtgttagggtttgcttggcttgctaagttgggtgaaacaagagcgaattggggaagattgagactcagctggcagattgggcgcacgtgggtgactatccatggagacccggagttgtgcagagaacaagtatcattccgcaccatggaaaaggagatcaaacatgcagatgaagcctatttgctggaattggctacactgtttgagagtgatgaacagcagaaaccaaaggaagtgacgccggttctgcaacgtgttctggatcaacaccagactgttttttaaatgccacaggccttgcctcccaagagaaacagggaacatgcgattacattggaaaaaggtacctcaccaatcaacttgagaccttatagatactcttatgaacagaaaaatgagatagagaagctcattagggaaatgctagcagctcaaatagatactcttagaagactcatgattcccctagcttgtatgagaagaagactgagagctggagggaagaaggcaagagtctgggagaagcttctgaagaagatactcaagagtggctagagtgcacaagagacactgaaggagaaagagggttcactttaatattgttgtcttttaattcaagtgttgcgttttatgtaagggttttgatacactctgtatttaaaggagggtttcccgtttagggcctcctcaatcattacctaccaaaaacattactattttctaatctctctctctttcctctccgccgcatctggcgcaatactatctccctcctatttcttcttgttacattctcgagtgaactgtcaagtttatcattttgattcttcgattttctttcttagtgccgctgatttagacgcaatttcagctagcttgcctacaaagtcatcaattttttcggtgtccttcatcttaaggttattaaattcgttcattagtgtctgtagtctagcttctttaatcgttatgcacctacgttcctagccttgatagcttcccaagctttctttgctaccttgaattctccaatctactaagttagagattcatgtatggattgaactaacaaggctatggccaagatcttatcttcatcgcttggatcggttgactctgtttcacttggagaacgatctgcatcttcatagcccaagctgtataattggtttgagtaagattgggatattgaatcgaagaagaccctccttcttttgatttcggtgttgacgcaactatttcactcatctctctctcttgatcttacaagttctccctatacggtcttaagatcttgtaagctctcataccaattcatgtgtttaaagtttgtatgtaagaacacaagatcaataagaatgactctcttattatgctttagaaacttacacaaaactaaagctttcaagttctctcaaatctcacaaactctcttaaggaccatgttacaactcaacatgtccttatatgtaaaagaatctagtcctaatactattagaaatacatatttagatatcgtaaatatcttctagattcattagaatttatctaattttctaaaccataactcggtttgaaccataactaggtttcggtttgattcctccttaagtcttcttcaagctaactccaacaacatgtcagtttcgaattgatccttttaatatcctaagagatatatatccgcacgtgtgttgatttaaatgattgagctggtgctagtcatgacgtatgatgttacaaactccaaatctagatatacatttttggtaggggattttgagccttaattccttttaatcccttttaatttacttggataggatattatccggtttaattatgttccaatcttgaataactttaatcgattgggttattacccgatttaatagtgtacggatcctggataacattaattcttgaaaaaagttaccattttctctaaaacaattaattaaaaacgaaattaattattgaattaccaaatttaataaatataatatctctaaactaagcatatatgttacttaccttaaataatttcctaaaacctctctaacttatttaaaaataaatctatgatttttcactttgatttgatcttatatttaatttaatttgaatttatataaaatacatatagtttagaaaattttctttttttgtatatgatgcgattcaaattttttaaaatggacatatattatccaatcgatgaggaaataatatgtgtacaatgtcctacattgcttaaaaaaatgtggccaatagtttagagtaaaaatgaccaaaatgattccgaatacaatgaacaagaaacttgagttctcaaacgtccaaaactagaattgttcgatttactctagttatttatttcaaagaatggaaactcttaaaaagtttcaaaatattaaaaatttaaactttatactacaggtaaaatcctagaattgacgggtttaggttgataataatacatgacgatataggacgggtgaaagcctagaattaataatcaatatataattatacaatcttaaataataaacaaaacaaaaaacattaacaaaacaaatacaactaatatttttttttaaatgcatctcaattattttatagaaattttaaatattatagatatttaagctttgtactaaagataatatcttagaattaatggattttggtcgataacaatatgggacgttatactacaggtgaaatcttaagattaacaatcaaaatataagtatacaattttaaacactacacaaaaaaacgaacaatattaacaaaaacatacaacttaaatttcattttttaaaaaacacattttgattattttataagaagtttaaacattataaacatttcaactttatactacgggtgaaatcctaaaattgacggatttaggtcgatattaatacatacttgtatactacgcgtaaaataaacaatcatgtacaatttttcactcttaaacactaaacaaaataaacaatattaacaaaagaaatacaacttaaatttttagttagattatatcgtctcgcggtgtaccatatatttaaattaaaaaacaaaatagcatatatttatagaagattttttttgaaataataatataggcccgtggtgtactacggttaatatctaatgtttagtataatgttttatgtaatgaaaaggtatgttgtggtactcacaaaagagaaaaattgtgggtatgaaacaagaaccaaaggagaactaaaaaaagagcatgcacatgcaatttcaaatcttcaattccctcacatttcatattcactcatcatgattcatatgcccctccattattcatcatgggtcgatgatctaacgactcacataaattccaaatgatatcttcccccacaaaaagtatttataaaaacaaaaactaaatgatatttggatggtaattagtagtgtcagtccctttaaaatcttctttgtttggtcattgagtttttttttatgcttcttctccaaattatgtcatcaataaaccttctatctataaagtttatcaaattataatcatcatatacaatataaatagatatcacttggagtttttcttagaagagaatgtttttttcttatctataataatatcattttgccttgtgcgtacggttattcggtttagaattttcagattttggtttggttcagtttgagattttgctcggccggttggttttgtttggatttacataaaatataaataaatgaacctaaataactaatattatttacccaaaaataaaatataaataactaattaatttagtgatttagtgatttttggttttcttcggttcaatttcttaattggatgcagttcagactactttataaaaaataaaataaaaattcttgctagaattcatttttattttgggttgacgaatttcgatctatattttcgtttaggaaaggaaattactttgatttatctttaccttaaaatgtgaatatgtgacaaccaatttgcttttcttaattcctttttaacttaagtgacaatcaagtaatactttgattcgttgtattatattatagatgagtaaattaaggtttagtctttagaagattcctccaatcattttgtagcgatatcaaatacaatactattaaacaccgtcgtaatcaataacacccaaccacacggaacaagtaatcagaacgaataactttttttttgtttgactagcaatgttacaatagagaatattatttcttgagagaactttgggaatattacagagaaaaattgatggcaacttcgaagcttcaagctctttggaatcatccagctggacctaagacaagtgagtcttcgatatccatgaatgtttttttcttcacttttgacttttcacacggtgagattgatcatagtatttttattattgaacaatcagtatttgtagaatttcatcttttgttcctcgatttgctttgtttcaaacctaattccaattcttgagtgactccgtaacagatccttcttagtttggttgatttttgtgtctctgaaaatggtttatcagtttatgcataagattcatattcggtttagatttgttaaagtttggtttagattagtttgcttaacatgctctgttttctccaatagactaatataagtttaatcaaacaagtgcatttggtagcttgatcaaacttgctacaaaaacctgaactgtaaaatcatttttgtatttgtcagttcatttttgggcgccgacgttcaagtggggtataagcattgccaatattgcagactttcaaaaacctccagagacactttcataccctcaacaaattggtattatactcactattggtcttagctatctttattctgcacatattgcggttatgtatcgatgtgtgaactttaatgtttatatgatgcctcgtatggctgtcattgtatcagtgatcacaggtactggacttgtttggtcacgttacagcactgtaattactccggtatgtattctgtgaatcatattgttgtcatttacagagtacattttgcttttctcttgtacttatttgttagatgattactggtttcttcttatgttggtctagctttttgtttacagaaaaactggaatctctttagcgtgagtcttggtatggctgtgacagggatataccaacttactcgtaaaataaagtaagatgtacagaagtgctttgctttgattagcaatgggaaaaaagaacaccttctttaactaaggaacatatatagtttggttatgacttgaatcatgggtttctaacttcaccattggtgtttgtctctgttttgacattgatatgtgtggattgcaggcacgattatgtatatgaagcaaattctattgttgcaaaagaatgatgaagatgaagatttgcggtttttattaaaaaccccatctttcttgcagattcattcaaaaatattatcatgtcaaggcttggttttgtttccatacccaaatctttttttgggttgttaattgtttatgttatagttagaaagtgaaatactggtgtgagtactataattgtataactcacactgattatcctgaagaatcttttaagcttgtaataacaactacatacgtaggaaatataccaccttttaagtacatattcttgagaaaaggcaaggaaaaagactctgtgtttactagtcttttatttttcaatctcaagaacatcctgagaccaagtgtggctaataatctatatatcattgttttccacctatagaggtgttgttggaataattgcatatacgtcgactactttgcgatgaagcaccctttggaaaagttcattcatatataggtacatcaaacccatttcttttaaaagtacgacaaaatccaactacactaacccgaccagtattgttttcttaattcaaaaccaaagagatcaaacaagatggaagctaacaatcaggcagagtagatgtttttaaattagatcatgaatgaaatatatcttattactagagaaaatctcacgcaactttgaattaatataataaatcatgcaacattttgtggctaagcatacatatcaaattaattaaatttattttcttacttaaatttttgctttagtatttatgaattaaaatatgataaattaaaccatacaaaatctctaagaaaatgttgtttttgtctccataaaaataaaattaagaccacatattgtaaaatatattaatttcgattcttttacacaagtttttaaccttgtgttaataggcatcttcgatatctttattatatttttaaattaatacatgcttttcatataatttgttatatccttagacattgtatcttctatatttaagcatataactaatgcattattggtagttggacattcatgtcattaaaagaaaaatcattcataataatcaaacaatttcaaaatgtcatcgataacttagacaaactcaacaaagaatgaacaaagagaaaacatagagaacaattcataatagagtaagagtactcacccttagatccaaaaacagacttttcacattatcattcacttgtaatctataacatgtttctattttcttcttacatgaaaatagaaaatgtcagtcacattatcattcacttgttttaattatttagtttttagttttcgtaccttgtggttgtcttctaatatttctaatttatcaatattttacaaattaggtacaacttttaaaatatattataaaataagtaacacttgattagttacacatcgaaagattttgaaaaccttactaatcgattatgttcaaaagtcttacaatgcgtagacaaaaagatctaaaacaataatttttatggtatttcaaaatacgattacttttgaaagatcacaaaatacaacaaataaaatttagttaaaaaaaaatgaaccaaataaaaaacataacattttcttacttttgggtgagttaaaaaaaaatgcaatcgcattgccccaccatcatatatttgcttctttagatctttgaatccaagtgaaaatggtattttaaattttgatgatgaaaataaactcaaataaattcattttttactctgaattttggttggatataaaaaatgtagtaactttactcataaccattttttaagacacttgagtctagaaaaaaaagacactcaattaaacttatgttaacggaaattgtttatgtaaagaaaataagatacatcaacatccacggattacataattgtttacattctgttctagcttcactacctaaacaaaaagaggaatttgtgttgcaatagtattaacaccattaagaaacacgtaacctaaagaaaatataaaacatggtttaaggatatttagataataaaataagaaaatacatacacacaaagctccaatgaaaaaagtgttgtgctaaacaccattagtaaatatagttctttttttttgtcaacaaatagatatagttaattttttcctaaatattatgaatcatgataattcactttgtcttttttttttgcaataatatcaatgccactaacaaatacggtaacctgaaaaaacaaaacataaaacatagttcaaagatatttaactgataaaattaaaaaggacatacccaaaaagctctaatgaaaaagttaatgtgtcaaacactataaaagtataaataaatatagttctttttttgtccgttgggataataacgatttccaacaacacataacaatctgagaaagtttataaaatatggttcaaagacgttaagttaattctatggcccattttgcatgttgtcctgattaggtcgggctatgcaaaatggtttggattggttgggacgtcatcactactatggggtgtgattggaaatatggtctcagtttgcgagctgacatgactacggccagtgcccgttttttcattgctggataacgggtttcagcgtctatcaacgttttactcacgtaatagatcgttttttatccctcgtgatcttctctcaccaggacactgcttatcgcggttcgggagactgccgtgtacaggtacagctgttctccttcttcaggttttgcgagtatgggtggttcggtcaggtatgctttcaattgcttgaaggcttgttcgcagtcctcattcaagtcaaactttttctcctttcagaggagctggtagaaagggacgcatttgtcggtggacctggatatgaacttgttcagggcagcaatacaaccgtttagccgttggacctctcgtgccttttttagtgataacattttgatgaaggctgcaatctgcttaggactgacctcgatgcctctttcggttactaggtatccgaggaattctcctgatggaactccgaaagagcatttctcaggatttagcttcatttcaaatttgtttaggattttgaagcattattttaatggtggaacgtggtcctttttgtgagctgatttgtccagcatgtcgtcgatgtagacctccatcgttttacctatctggtcagcgaacattttgttcaccaatcgttggtaggtggctccagcattttttaaaccaaagggcattactttaaaaaagtaggtgcctcggtcagtaataaaagctgttttttcttggtcatctaggcgcataagtatttggttatacccggagaatgcgtccatgaaggacagtagttcgtgtcctacaatggcttcgacaagtcggtcgatatgcgggagtgggaaactgtctttaggacatgctttattcaggtccgtaaagtcgatgcatactctccacttcccgtttttctttttaacgacgactgggttggcgagccagtcagggtattttacttcccttatcgatccaaatttgagcaatcagtcgacatcatcgttcatagccttagccctttcaggacctagcttgcgacgtttctgctttataggtcggtaggtcggatcgacgttgagttcgtgtgaggttacctcgaggcttattcctcgaatgtttgcgcttgaccaggcaaagctgtctttgttttccttgagaaaggttacgagatcctctcatattgttgggtcgaggtcgtgacctatcctaacgcatcgtttaggatctgattcgtctatgcagacctgcgttatcagcgatttttgaggtccacgttgagaagggtcggaggacctgactgttttcatttctgcgagtttgtcctctatcattattaccacggggtcggcttttttgatatgctcgtaaccacccatataacattttcgggagctgcgctggctgccgtatacgactgttatccccttgtcggaggggaatttaatgtattggtagtaggtcgatgggacggctttcatggcgtgtagccatggtcttcccagtattgcgttgaaaggagctttcttatcgaccacgaggaagttcgtgagttgtcttactccccgtgcgacggttgggagctggatggttcctagggaaaaggtcgtatctccatcaaacccggtaagtggcgtttttctgccttgcaactcggaatcgaggtgccccatttttttgaaggcgtcgtagaagagtacgtcaactgagcttctcgtgtcgatcattatacgagagagttcgtagttgcctacgtcgattcggatatcaagagcgtcaatgtgaggtttattgaggtcagtggtttcattttcccagaatgtgatctggtgatcgaggccggtttgttttaggagaaaactagatcatggtcgaggaacgaaccaaaatactaagtaggaagaaagagaaagttcaagctaaaccagctaggtgagctggacaagctggatgaactagctagctaagctatgtgagctaaaccagctggaagactagctagctcagctagttgagctgaccaacagctcgactaagctcggtgagcggagtactgacccagatgggtggtccggtcagctgacactcgagctggtggactgtggtaactcatgggtgaagaggtgtctcggccaaaaggtgcaaggtcgagcgggtaccaatgaacgtttgcatcgcccatagaatgcaaggaacggatgtgacttttcggaaggatgcaaggaagggatgtgacctttcggaagggtgcaaggaacggatgggatgcttcaggaagcatccattcgccccctatataagggaggacgcccaaggtctttagagcatctcatacaacatccatacaccacaaaatattctcaaaacagtcccaacacatcctgaagttgttggtcagaaagggggtgcggctcggcgagtataagtcgaccgaactgatgcgcataccacctctcggtccaacggtttgatggagtgtagaggatggagagggtagaccgttcgtcttagagacaaatcggatctggtagaccgatcgtcgtatcggatcggccaaaccgatcgtcggacggatcggatcggccagacggatcggattggacagaccgatcttcggacgggtcggatgggatagactgatcgtcagacggaacgagtcggacagaccgatcgtcggatgggatggatcaagaaaagtgtttgaggaaggacaaggataagtgcatccgaacacacccaagggtcgcccatggatgcaatcttactggtaaagggagaaagcaccaagaatgggtaaggaacgtgattcaccatataggatcaatatcgcggctgccttcatgtatctatctcctcagccatggtgaaaccgatcggagatcggtaagaccaaagggtgactcgacggataaccaacgggaaagtccacagttggaaccgatggacaaaacggatgttggacccgcgagcaaacctaaggccgatggaagaaggatttcatgggctagcctacgatactccggtggatgaatccacggacccttgggtgtgataaggatatcgttcagaccgcatggatggatcattaaggcgaaagctttatcgacgggtaaacggttagtaaaccgtgggcggtcgtagtgttaaacgaccggatcggaaacatggatgattcgataagccaagggctcaatcgtccaccatggaaccgaaggggcgtacgtttggaggacagatggaccaatccaagagcttgattcggccatcgtgaaccaagggaatcgtacgatccccaatctctatcgttgtacttagaccagtgtggttggttggttgtatggctaagtaacgatagggattggttcatcaattcacgatcgcatacgaatcgttgaacgaatagaataaggcgacaaatgggctagggaatcaaatccgcatattggccaaggtatgtaacgatctagcttactagttaggatagacgtttgggaatcgaccgtgaaaataggataaaggaatatgcgattgttaggcctagaatggttaccgaacaatatgcatgtcttgaccgagtaaaggattgatctaagtctaagggacaaagacgatgaaaccggtacaagagttggttagaattaaaccaaggttagaaagacttccgctgtgtaataagagagcgattatagaattaagcctcgtaaaggcaattctatgttgaatcgcaaaaaattaagaggttcggccgggaagaggcgcgaacttgagtccaacgtcgccggacgccgagacgtccggaacggggtctcacatcatcgggcttttgccttttgtgtaggaatctgccttcctctgatgtgtttgatcaaattgattgagtcgttgcagagccgagattctcccatgatgaaatcgatgcgtttcagggagaggtgctcggttgcgtttctacagaatttcgggaggcataatgggaacctcatgtttttcttttgcggggcgagaggaggtgtagtgactgatatttctgtcctaccttccagatcaagtcctgcaaagagtaggtctgtgcgctctttcctagcaggtggaggagactcacctcctttcggtgttcagtcccgtttctttcgtttgggagtttgctcctcctcctgctcgtcgggaggaggggtgtcggcattagcgtttgaaccttttttagttttgcccccggctgcgattaattttttaacgccgcgacattcctcgatggaatgtcctctctttttgtggtacttgtaatatttttcgtggtcaagttctggactctcgtcctcggctgcctcttctattgcaaataaggtatgctaccctagtatttggttttcctttttgaagggttttttagttgcaagggaagcgttttgtgctttagattctttgaatcttagggccgaaacggcgagctcctctccggactccggctttggcgaagtggagagctttgtgaagggcatcgtctaaagagaccagttgcctaacggtgagttcctcacggaacctagaggaaaaccacaagccgttgcgaagggcggctatggctacctcctcgtttaggttcgcaatctttgatttgattgctttgaatttttcgacgtaagatcgcaaaaattcgttctgaagttgggtgacacccagaggacggcttcagacgtcctgtttacgatgagtaccgagtactgtttttagaaggcgggggcaagctggtcgaaggtatcaatagagttccctttgagactagcaaaccatttgagtgcgtcacatacgaggttctctgcaaagaaacggcaatgacctgcttcattttctttgtctatcaggtacgctcgtgttatagccagacagaaggctctcagatgagcctttgggtcactcgttccatcgtactccaggaaacggagtctcccggcgtctaagatgtgacaatgggcgatcctatccgtgaatggggtgcgcctggtttcttcgatcactcgatctatgctagatgcattcgtgcccgtcggcgacgttatcgtttgcgatctgacttggtacgctagatctcattgaatcggatgaattaggatccatgatcgttggtcacaattgatgtgttagtttcggtgttggaaggatctatttcggtccccacagacggcgccaaatgtgggttctgaaatccacagtacagatttgtaattgagattatgagaaaggagggctagatcttcacaggaacattgagatttatattgctaagaaccaatggacttgtgtattgattatcacagagcttttacaatgtgaaaggagattacaagtgtaaaagtgtaagtgtgaatgtaaagctgaatttaatgtcttccaagtcgtccttgctttcttatatagatctacgcacgtggtagcttcgtccgggatctgcggagattctcttagatattcggcaggtcaattccaagatatcaggtccattctgcgaatatctccctgttagttcctaggttgttattcgcttatctcccttcatcaggtgaccgggcttatcaggcccaagtaccgatttgcgtacgtgggctcatcagttgcgcaggtcttctacttggtgggcttggtgggttggcctggtatttttgcaggtggattcctggaggaaaatccagctccaatagtgatgaagctgaaagatcaactatggatgtttgaaaaaagatttaataagttttcaatgagtattgatccagagaagatggaaactacactagctatcaaagaggacaaaagatttcgcaatagaatggtttgcaccagaagatcagaaaggagttcacttagaggaaagaagcttggagagcaagttgttgagtgaggaggaaattattccgacttattctccagaggtacctaaaccgcccactaaaccctcttctgaagaagaacacttgattcttgattctattgctgaagaactcctggagctttggattgggtataaagctcaggaggatacaattggaaagttaattcataagatggaagagttaaatagcaccattctggaacttcaagaaatggttaaaggctaccccagttttgaacttgaggattggtcaaaggagcctggttcagaagaagaagactactctgctgatcaaaaagaagcttattttgaagaaaaatcaaatgagtactcatcctaccatatgtcaagaaaggatgcaacgtatgattcagacactgaaaattcaaccactgaagatgaggacttctctgttcctctcctcaacctttttctgactaagctttgtaagagtcaagcttagtgacttaaaacaagctcacttgggggggaagtcccatgtctatccatgtatataactttatatttttcttgttatttttgatgtttttgtttaagtgtttcaggtttatttcattgaccttgaggaagtcaacgttcgagtaaaatcaaacctagtcaagagatgatctcaaccattcgagtaaattgaggaggagtgctctaagtcgttggattgaatgatcaaatgagaaaagcatcatcaccgttttgatcgagtgacttcttgaggtttattatggtccgtttgatcgagtgattaatagcgaagcactctccaccgtctgattgagtgaagaaaccaaagagaccaccttgtggattccgacgcctcgtgacccgcctccattgaattccatcatacctccttgtcttcttgtcccctcataataattttggtccccccattgcaattcccgaacactacaaactcatctctccacctccataccaaagcaatctcgaattcttatacctctctctatccctttctcttgcacttcctctttttatcaaaaactcaacataatccatctattttcttcatcactcgatctcctaacctttgagtctctcgttctcaatgacaaacaagcgcacgctcctgtcaaggatccgaaacatagctctctccccatcgaagaggtacccaacacgttcttcacatgcagcagctcgaagactttctgaaccatcacccatagggtcgagcaggagagaacgagcaagtttcgagatcaatcacagcgaatcaagccaagacgaggatgcatgcaagaagaacaaactttcaactcccccgccgaaaacactcgatcccgaaggtcgagtaaggcctctacaagggagttctcaaggaacaaggaagatatcactcgatgaaagaagcccgtggggagaaggttggaactggtagatgaagactccgaggaagaaatggcttcacctgaggaagcagatcaaacagagaatggaggtggtgatgatttggaatcagagaagtgcgcaactcgaaacgagtactacaaactactgaaacgcaacgagtttttaggaactcgataccctcatcctgagaccatggagagactcggcatatatgatgatgtagagtacatgtttaagcagtgcagccagaatattcacatgtttcggccaatggatgggtatgaggaagagaccgtcaattttctttcatctgtagaattgttcatatatggagagtcagaggacgatggaatcaggccagacggaagtttgggatacttggagttctgtgtctatgacgtagagtatcggcttccaatcgatcatttagagcatatgtatgggttcccaagcgaaaaagacacgagtcatcgttttgacaagagagagcttcagtcattcttggccatgcttgggtctaaacatgggttttcatcctctaggaccaagagcaacgaataaggagtccggtggttaggtactttcataggtctttagccagtgcactatttgcaagagagaggaatgggacctttgacaatggagagctagaattgttggagacagcgctacaggagctacttggtttagcatcagatggtaccgttctagcaggagatcagacagaagcttcagtttcattctacctaatcgaacatctgctgagctacagaggatggactaagggacttaagaaaccaggaagaatggctatgggaggagttgcgaccctaattctcagagcatgcaatgtacctctacattcaaaacagattcctccgagatggattgatatgcaacacctcataaattccaaacaatttttgtcgcagcagaagaattacctatataaatataggttcgatcaccctgcagcaggacaatctatttttctccttctaaattccgcctccacttcgatcagagattgcggcaacatcgagttttgcccaccagtagagaccctgtatacttcaggtgatgtatgtaatatgtagtattgagtataagaactagaaccgcaaccggttcccaaaagctaaagttgtgtttccttgttagaagatacaaagccaaagactcttacggacttcggcaacaccatgaaaatattgagaagcaataagaagcttggttagtgttttggagtcaaatatgactagatgtcatgtgtatgattgagtataagaactagaacggcaaccgattcccaatagccgaagttatgtttccttgttagaagatacaaagccaaagactcatacggacttcggatacaccaccaaaattttgagaagcaatacgaagcttggttagtattttagagtcaaatattacaagatgtcatgtgtatcattaagtataagaagtagaaccgcaaccgatttccaaaagataaagtaatgtttccttgtttgaagatacaaagtgaaagactcatacggacttaggctacatcatcaaagctttgtgaggcaataagaagcttggttagttttttggagtcaaatatgactagatgtcatgtgtatgattgagtataagaactagaaccgcaactgattcttaaaagctaaagtaatgtttccttgttagaagatacaaagctaaaaacgcatacggacttcggctaaggcatcaaagttttgagaagcaataagaagattggatagtgttttggagtcaaatatgactagatgtcatgtgtatgattgagtattagaactagaaccgcaaccgtttcccaaaagctaaaggtgtgtttccttgttagaagatacaaagccacaaaatcatatggacttcagctacaccatcaaagctttgagaagcaataagaagttttgatagtgttttagagtcaaatatgactagatgtcaagtggataattgagtataagaactagaaccgcaaccggttcccaaaggctaaagtagtgttttcttgttaaaagatacaaagccaaagactcatacggacttcggatacaccatcaacattttgagaagcaataagaaccttagttagtattttggagtcaaatattacaggatgtcatatgtatcattgagtataagaaaaagacacgcaattgattcccaaaagctaaagtaatgtttccttctttgaagatacaaagccaaaaactcatacggactttggctacaccatcaaagttttgtgagacaataagaagcttggttagtttttgggagtcaaatatgactagatgtcatgtttatgattgagtataagaactagaaccgcaactaattcccaaaagctaaattaatgtttccttgttgaaagatacaaagctaaaaactcatacggacttcgactaagccatcaatgttttgaaaagcaataagaagtttggttagtgttttggagtcaaatatgactagttgtcatgtgtatgattgagtataagaactagaaccgcaactgtttcccaaaagctaaagtagtgtttccttgttagaagctacaaagccaaagactcatacggacttcggctacaccatcaaagttttgagaagcaataagaaaagctttgttagtgttttggagtcacatatgactagatgtcatgtggatgattgagtataagaactagaactgcaactggttcccaaaagctaaagtaatgtttcctagttagaagatacaaagccaaagactcatacggactttggctacaccatcaaagttttgagaagcaataagtagcttggttagtattttggtgtcaaataagacaagatgttatgtgtatgattaagtataagaactttaaccacaactgattcccaaaagctaaagtaatgtttccttgttagaagatacaaagctaaaaactcatacggacttcggctaagccatcaaaattttgagaagcaataagaagcttggtttgtgttttggagtcaaatatgactagatgtcatgtgtatgattgagtataagaactagaaccgcaaccgtttcccaaaagctaaagtagtgtttccttgttagaagctacaaagccaaagactcatacggacttcggctacaccatcaaagttttgagaagcaataagaagcttggttagtattttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttgaagtcaaaaaagaatatatgtcatgtgtagtattgagtataaaaactagaaccacaactggatcccaaaagcaaaagtagtgtttccttgttagaagatacaaagccaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgttagaagatacaaagccaaagactcatacggacttcggctacaccatgaaaattttgagaagcaataagaagcttggttagttttttggagtcaaatatgactagatgtcatgtgtatgattgagtataagaactagaatggcaaccgattcccaatagctaaagttatgtttccttgttagaagatacaaagccaaagactcatacggacttcgtgtacaccatcaaaattttgagaagcaataagaagcttggctagtattttagagtcaaatattacaggatatcatgtgtatcattgagtataagaactaggaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaacaagaaccgcaactaattcccaaaagctaaattaatgtttccttgttagaagatacaaagctaaaaactcatacggacttcggctaagccattcatgttttgagaagcaataggaagcttggttattttttttggagtcaaatatgacttgatgtcatgtgtatgattgagtataagaactagaaccgcaaccgtttcccaaaagctaaagtagtgtttccttgttagaacatacaaagcaaaagaatcatatggacttctgctacaccatcaaagctttgaggaacaataagaaaagctttgttatggttttggagtcacatatgactagaggtcatgtggatgattgagtataagaactagaaccataactgattcccaaaagctaaagtaatgtttccttgttagaagatacaaagctaaaaactcatacggacttcggctaagccatcaaaattttgagaagcaataagaagcttggttagtgttttggagtcaaatatgactagatgtcatgtgtatgattgagtataagaactagaaccgcaaccgtttcccaaaagctaaagtagtatttccttgttagaagctacaaagccaaagactcatacggacttcggctacaccatcaaagttttgagaagcaataagaagcttggttagtattttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtaaaaaaagactatatctcatgtgtagtattgagtataaaaactagaaccgcaactggttcccaaaagcaaaagtagtgtttccttgttagaagatacaaagccaaagactcatacggacttcggctacaccatgaaaattttgagaagcaataagaagcttggttagtgttttggagtcaaatatgactagatgtcatgtgtatgattgagaataagaactagaatggcaaccgattccctatagctaaagttatgtttccttgttagaagatacaaagccaaagactcatacggacttcgtttacaccatcaaaattttgagaagcaataagaagcttggtaagtattttagagtgaaatattacaggatatcatgtgtatcattgagtataagaactagaaccgcaaccgattcccaaaagctaaagtaatgtttcttgtttgtagatacaaagccaaagactcataccgacttcggctacaccatcaaagttttgtgaggcaataagaagcttgtttagtttttcggaatcaaatatggctagatgtcatgtgtatgattgagtataagaactagaaccgcaactaattcccaaaagctaaattaatgtttccttgttagaagatacaaagctaaaaactcatacggacttcggctaagccattaatgttttgagaagcaataagaagcttggttatttttttggagtcaaatatgactagatgtcatgtgtatgattgagtataagaactagaaccgcaaccgattcccaaaagctaaagtaatgtttccttgtttgaagatacaaagtcaaagactcatacggacttcggctacaccatcaaaactttgtgaggcaataagaagcttcgttagttttttggagtcaaatatgactagatgtcatgtgtatgattaagtataagaactagaaccacaactgattcccaaaagctaaagtaatgtttccttgttagaagatacaaagctaaaaactcatacggacttcggctaagccatcaaaattttgagaagcaataagaagcttggttagtgttttggagtcaaatatgactagatgtcatgtgtatgattgagtataagaactagaaccgcaaccgtttcccaaaagctaaagtagtgtttccttgttagaagctacaaagccaaagactcatacggacttcggctacaccatcaaagttttgagaagcaataagaagcttggttagtattttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtaaaaaaagactatatctcatgtgtagtattgagtataaaaactagaaccgcaactggttcccaaaagcaaaagtagtgtttccttgttagaagatacaaagccaaagactcatacggacttcggctacaccatgaaaattttgagaagcaataagaagcttggttagtgttttggagtcaaatatgactagatgtcatgtgtatgattgagaataagaactagaatggcaaccgttcccaatagctaaagttatgtttccttgttagaagatacaaagccaaagactcatacggacttcgtgtacaccatcaaaattttgagaagcaataagaagcttggttagtattttagggtcaaatattacaggatatcatgtgtatcattgagtataagaactagaaccgcaaccgattcccaaaagctaaagtaatgtttcttgtttgtagatacaaatccaaagactcataccgacttcggctacaccatcaaagctttgtgaggcaataagaagcttggttagtttttcggaatcaaatatggctagatgtcatgtgtatgattgagtataagaactagaaccgcaactaattccgaaaagctaaattaatgtttccttgttagaagatacaaagctaaaaactcatacggactccggctaagacattaatgttttgagaagcaataagaagcttggttattttttttggagtcaaatatgactagatgtcatgtgtatgattgagtataagaactagaaccgcgaccgattcccaaaacctaaagtaatatttccttgtttgaagatacaaagtcaaagactcatacggacttcggctacaccatcaaaactttgtgaggcaataagaagcttcgttagttttttggagtcaaatatgactagatgtcatgtgtatgattaagtataagaactagaaccataactgattcccaaaagctaaagtaatgtttccttgttagaagatagaaagctaaaaactcatacggacttcggctaagccatcaaaattttgagaagcaataagaagcttggttagtgttttggagtcaaatatgactagatgtcatgtgtatgattgagtataagaactagaaccgcaaccgtttcccaaaagctaaagtagtgtttccttgttagaagctacaaagccaaagactcatacggacttcggctacaccatcaaagttttaagaagcaataagaagcttggttagtattttggagtcaaataacacaagatgttatgtgtttgattgagtataagaactagaaccgcaacagcttctcaaaagctaaagttgtgtttcccttatagaagatacaaagccaaaaactcatacggactttggctacaccatcaaagctttaagaagcaacaagaagtttggttagtgttttggagtcaaaaaagactatatgtcatgtgttgtattgagtataaaaactagaaccgcaacttgttcccaaaagcaaaagtagtgtttccttgttagaagatacaaagccaaagactcatacggacttcggctgcaccatgaaaattttgagaagcaataagaagcttggttagtgttttggagtcaaatatgactagatgtcatgtgtatgattgagtataagaactagaattgcaaccgattcccaatagctaaagttatgtttccttgttagaagatacaaagccaaagactcatacggacttcgtgtacaccatcaaaattttgagaagcaataagaagcttggttagtattttagggtcaaatattacaggatatcatgtgtatcattgagtataagaactagaaccgcaaccgattcccaaaagctaaagtaatgtttcttgtttgtagatacaaagccaaagactcataccgacttcagctacaccatcaaagctttgtgaggcaataagaagcttggttagtttttcagaatcaaatatggctagatgtcatgtgtatgattgagtataagaactagaaccgcaactaattcccaaaagctatattaatgtttccttgttagaagatacaaagctaaaaactcatacggacttcggctaagccattaatgttttgagaagcaataagaagcttggttatttttttggagtcaaatatgactagatgtcatgtgtatgattgagtataagaactagaaccgcaaccgattcccaaaagctaaagtaatgtttccttgtttgaagatacaaagtcaaagactcatacggacttcggctacaccatcaaaactttgtgaggcaataagaagcgtcgttagtttttgggagtcaaatatgactagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttcgttagtgttttggagtaaaaaaagactatatgtcctgtgtagtattgagtataaaaactagaaccgcaactggttcccaaaagcaaatttagtgtttccttgttagaagatacaaagccaaagacacatacggacttcggcaacaccatgaaaattttgagaagcaataagaagcttggttagtgttttggagtcaaatatgactagatgtcatgtgtatgattgagtataagaactagcatggcaaccgattcccaatagctaaagttatgtttccttgttagaagatacaaagccaaagactcatacggacttcgtgtacaccatcaaaattatgagtagcaataagaagcttggttagtattttagagtgaaatattacaggatatcatgtgcatcattgagtataagaactagaaccgcaaccgattcccaaaagctaaagtaatgttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggacttcggctaagccattaatgttttgagaagcaataagaagcttggttatttttttggagtcaaatatgactagatgtcatgtgtatgattgagtataagaactagaaccgcaaccgattcccaaaacctaaagtagtgtttccttgttagtagatacaaagccaaagactcatacggacttcggctacaccatcaaaactttgtgaggcaataagaagcttggttagtgttttggagtcaaatatgactagatgtcatgtgtatgattgagtataagaactagaactgcaaccgtttcccgaaagctaaagtagtgtttccttgttagaagctacaaagccaaagactcatacggacttcggctacaccatcaaagttttgagaagcaataataagcttggttagtatttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagactatatgtcatgtgtagtattgagtataaaaactagaaccgcaactggttcccaaaagcaaaagttatgtttccttgttagaagatacaaagccaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgtttgaagataccaagctaaagactcatacggacttcgtgtacaccatcaaaattttgagaagcaataagaagcttggttagtattttagagtcaaatattacaggatatcatgtgtatcattgagtataagaactaggaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggacttcggctaagccattcatgttttgagaagcaataggaagcttggttatttttttggagtcaaatatgattgatgtcatgtgtatgattgagtataagaactagaaccgcaaccgtttcccaaaagctaaagtagtgtttccttgttagaacatacaaagcaaaagaatcatatggacttcagctacaccatcaaagctttgaggaacaataagaaaagctttgttatggttttggagtcacatatgactagaggtcatgtggatgattgagtataagaactagaactgcaactggttcccaaaagctaaagtaatgtttcctagttagaagatacaaagccaaagactcatacggactttggctacaccatcaaagttttgagaagcaataagtagcttggttagtattttggtgtcaaataagacaagatgttatgtgtatgattaagtataagaactttaaccacaactgattcccaaaagctaaagtaatgtttccttgttagaagatacaaagctaaaaactcatacggacttcggctaagccatcaaaattttgagaagcaataagaagtttggttagtgttttggagtcaaatatgactagatgtcatgtgtatgattgagtataagaactagaaccgcaaccgtttcccaaaagctaaagtagtgtttccttgttagaagctacaaagccaaacactcatacagacttcggctacaccatcaaagttttgagaagcaataagaagcttggttagtattttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagattatatgtcatgtgtagtattgagtataaaaactagaaccacaactggatcccaaaagcaaaagtagtgtttccttgttagaagatacaaaggcaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccctgttagaagatacaaagccaaagaatcatacggacttcgtgtacaccatcaaaattttgagaggcaataagaagcttggttagtattttagagtcaaattttacaggatatcatgtgtatcattgagtataagaactagaaccgcaaccgattcccaaaagctaaagtaatgtttcttgtttgaagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggacttcggctaagccattcatgttttgagaagcaataggaagcttggttatttttttggagtcaaatatgactgatgtcatgtgtatgattgagtataagaactagaaccgcaaccgtttcccaaaagctaaagtagtgtttccttgttagaacatacaaagcaaaagaatcatatggacttcagctacaccatcaaagctttgaggaacaataagaaaagctttgttatggttttggagtcacatatgactagaggtcatgtggatgattgagtataagaactagaactgcaactggttcccaaaagctaaagtaatgtttcctagttagaagatacaaagccaaagactcatacggactttggctacaccatcaaagttttgagaagcaataagtagcttggttagtattttggtgtcaaataagactagatgtcatgtgtatgattaagtataagaactttaaccacaactgattcccaaaagctaaagtaatgtttccttgttagaagatacaaagctaaaaactcatacggacttcggctaagccatcaaaattttgagaagcaataagaagtttggttagtgttttggagtcaaatatgactagatgtcatgtgtatgattgagtataagaactagaaccgcaaccgtttcccgaaagctaaagtagtgtttccttgttagaagctacaaagccaaagactcatacagacttcggctacaccatcaaagttttgagaagcaataataagcttggttagtattttggagtcaaataagacaagatgttatgtgtttgattgagtataagaactagaaccgcaacatcttccgaaaagctaaagttgtgtttcccttctagaagatacaaagccaaaaactcatacggactttggctacaccatcaaagctttaagaagcaacaagaagtttggttagtgttttggagtcaaaaaagattatatgtcatgtgtagtattgagtataaaaactagaaccacaactggatcccaaaagcaaaagtagtgtttccttgttagaagatacaaagccaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgtttgaagatacaaagctaaagactcatacggacttcgtgtacaccatcaaaattttgagaagcaataagaagcttggttagtattttagagtcaaatattacaggatatcatgtgtatcattgagtataagaactaggaccgcaaccgattcccaaaagctaaagtaatgtttcttgtttgtagatacaaagccaaagactcataccgactttggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggacttcggctaagccattcatgttttgagaagcaataggaagcttggttatttttttggagtcaaatatgactgatgtcatgtgtatgattgagtataagaactagaaccgcaaccgtttcccaaaagctaaagtagtgtttccttgttagaacatacaaagcaaaagaatcatatggacttcagctacaccatcaaagctttgaggaacaataagaaaagctttgttatggttttggagtcacatatgactagaggtcatgtggatgattgagtataagaactagaactgcaactggttcccaaaagctaaagtaatgtttcctagttagaagatacaaagccaaagactcatacggactttggctacaccatcaaagttttgagaagcaataagtagcttggttagtattttggtgtcaaataagactagatgtcatgtgtatgattaagtataagaactttaaccacaactgattcccaaaagctaaagtaatgtttccttgttagaagatacaaagctaaaaactcatacggacttcggctaagccatcaaaattttgagaagcaataagaagtttggttagtgttttggagtcaaatatgactagatgtcatgtgtatgattgagtataagaactagaaccgcaaccgtttcccaaaagctaaagtagtgtttccttgttagaagctacaaagccaaagactcatacagacttcggctacaccatcaaagttttgagaagcaataagaagcttggttagtattttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagattatatgtcatgtgtagtattgagtataaaaactagaaccacaactggatcccaaaagcaaaagtagtgtttccttgttagaagatacaaaggcaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgtttgaagatacaaagctaaagactcatacggacttcgtgtacaccatcaaaattttgagaagcaataagaagcttggttagtattttagagtcaaatattacaggatatcatgtgtatcattgagtataagaactaggaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggacttcggctaagccattcatgttttgagaagcaataggaagcttggttatttttttggagtcaaatatgactgatgtcatgtgtatgattgagtataagaattagaaccgcaaccgtttcccaaaagctaaagtagtgtttccttgttagaacatacaaagcaaaagaatcatatggacttcagctacaccatcaaagctttgaggaacaataagaaaagctttgttatggttttggagtcacatatgactagaggtcatgtggatgattgagtataagaactagaactgcaactggttcccaaaagctaaagtaatgtttcctagttagaagatacaaagccaaagactcatacggactttggctacaccatcaaagttttgagaagcaataagtagcttggttagtattttggtgtcaaataagacaagatgttatgtgtatgattaagtataagaactttaaccacaactgattcccaaaagctaaagtaatgtttccttgttagaagatacaaagctaaaaactcatacggacttcggctaagccatcaaaattttgagaagcaataagaagtttggttagtgttttggagtcaaatatgactagatgtcatgtgtatgattgagtataagaactagaaccgcaaccgtttcccaaaagctaaagtagtgtttccttgttagaagctacaaagccaaagactcatacagacttcggctacaccatcaaagttttgagaagcaataagaagcttggttagtattttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagattatatgtcatgtgtagtattgagtataaaaactagaaccacaactggatcccaaaagcaaaagtagtgtttccttgttagaagatacaaaggcaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccctgttagaagatacaaagccaaagaatcatacggacttcgtgtacaccatcaaaattttgagaagcaataagaagcttggttagtattttagagtcaaatattacaggatatcatgtgtatcattgagtataagaactagaaccgcaaccgattcccaaaagctaaagtaatgtttcttgtttgaagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggacttcggctaagccattcatgttttgagaagcaataggaagcttggttatttttttggagtcaaatatgactgatgtcatgtgtatgattgagtataagaattagaaccgcaaccgtttcccaaaagctaaagtagtgtttccttgttagaacatacaaagcaaaagaatcatatggacttcagctacaccatcaaagctttgaggaacaataagaaaagctttgttatggttttggagtcacatatgactagaggtcatgtggatgattgagtataagaactagaactgcaactggttcccaaaagctaaagtaatgtttcctagttagaagatacaaagccaaagactcatacggactttggctacaccatcaaagttttgagaagcaataagtagcttggttagtattttggtgtcaaataagacaagatgttatgtgtatgattaagtataagaactttaaccacaactgattcccaaaagctaaagtaatgtttccttgttagaagatacaaagctaaaaactcatacggacttcggctaagccatcaaaattttgagaagcaataagaagtttggttagtgttttggagtcaaatatgactagatgtcatgtgtatgattgagtataagaactagaaccgcaaccgtttcccaaaagctaaagtagtgtttccttgttagaagctacaaagccaaagactcatacagacttcggctacaccatcaaagttttaagaagcaataagaagcttggttagtattttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagattatatgtcatgtgtagtattgagtataaaaactagaaccacaactggatcccaaaagcaaaagtagtgtttccttgttagaagatacaaaggcaaagactcatacggacttcggctacaccatgaaaattttgagaagcaataagaagcttggttagtgttttggagtcaaatatgactagatgtcatgtgtatgattgagtataagaactagaaccgcaactaattcccaaaagctatattaatgtttctttgttagaagatacaaagctaaaaactcatacggacttcggctaagccattcatgttttgagaagcaataggaagcttggttatttttttggagtcaaatatgactgatgtcatgtgtatgattgagtataagaagtagaaccgcaaccgattcccaaaagctaaagtaatgtttccttgtttgaagatacaaagtcaaagactcatacggacttcggctacaccatcaaaactttgtgaggcaataagaagcttcgttatttttagagtcaaatatgactagatgtcatgtgtatgattaagtataagaactagaaccacaactgattcccaaaagctaaagtaatgtttccttgttggaagatacaaagctaaaaactcatacggacttcggctaagccatcaaaattttgagaagcaataagaagcttggttagtgttttggagtcaaatatgactagatgtcatgtgtatgattgagtataagaactagaaccgcaaccgtttcccgaaagctaaagtagtgtttccttgttagaagctacaaagccaaagactcatacagacttcggctacaccatcaaagttttgagaagcaataataagcttggttagtattttggagtcaaataagacaagatgttatgtgtttgattgagtataagaactagaaccgcaacatcttccgaaaagctaaagttgtgtttcccttctagaagatacaaagccaaaaactcatacggactttggctacaccatcaaagatttaagaagcaacaagaagtttggttagtgttttgaagtcaaaaaagactatatgtcatgtgtagtattgagtataaaaactagaaccgcaactggttcccaaaagcaaaagttatgtttccttgttagaagatacaaagccaaagactcatacggacttcggctacaccatgaaaattttgagaagcaataagaagcttggttagtgttttggagtcaaatatgactagatgtcatgtgtatgattgagtataagaactagaaccgcaaccgtttcccaaaagctaaagtagtgtttccttgttagaagctacaaagccaaagactcatacggacttcgtgtacaccatcaaaattttgagaagcaataagaagcttggttagtattttagagtgaaatattacaggatatcatgtgtatcattgagtataagaactagaaccgcaaccgattcccaaaagctaaagtaatgtttcttgtttgtagatacaaatccaaagactcataccgacttcggctacaccatcaaagctttgtgaggcaataagaagcttggttagtttttcggaatcaaatatggctagatgtcatgtgtatgattgagtataagaactagaaccgcaactaattccgaaaagctaaattaatgtttccttgttagaagatacaaagctaaaaactcatacggactccggctaagccattaatgttttgagaagcaataagaagcttggttattttttttggagtcaaatatgactagatgtcatgtgtatgattgagtataagaactagaaccgcaaccgattcccaaaacctaaagtaatatttccttgtttgaagatacaaagtcaaagactcatacggacttcggctacaccatcaaaactttgtgaggcaataagaagcttcgttagttttttggagtcaaatatgactagatgtcatgtgtatgattaagtataagaactagaaccacaactgattcccaaaagctaaagtaatgtttccttgttagaagatacaaagctaaaaactcatacggacttcggctaagccatcaaaattttgagaagcaataagaagcttggttagtgttttagagtcaaatatgactagatgtcatgtgtatgattgagtataagaactagaaccgcaaccatttcccaaaagctaaagtagtgtttccttgttagaagctacaaagccaaagactcatacggacttcggctacaccatcaaagttttgagaagcaattagaagcttggttagtattttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagactatatgtcatgtgtagtattgagtataaaaactagaaccgcaactggttcccaaaagcaaaagtagtgtttccttgttagaagatacaaagccaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgttagaagatacaaagccaaagactaatacggacttcgtgtacaccatcaaaattttgagaagcaataagaagcttggttagtattttagagtcaaatattacaggatatcatgtgtatcattgagtataagaactagaaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggactttggctaagccattaatgttttgagaagcaataagaagcttggttatttttttggagtcaaatatgactagatgtcatgtgtatgattgagtataacaactagaaccgcaaccgtttcccaaaagctaaagtagtgtttccttgttagaagttacaaagccaaagaatcatatggaattcagctacaccatcaaagctttgagaagcaataagaagctttgttagttttttggagtcaaatatgacaagatgttatgtgtttgattgtgtttcccttctagaagatacaaagccaaaaactcgtacggactttggctacaccatcaaagctttaagaagcaacaagaagtttggttagtgttttggagtcaaaaaacactatatgtcatgtgtagtattgagtataaaaactagaaccgcaactggttcccaaaagcaaaagttatgtttccttgttagaagatacaaagccaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgtttgaagatacaaagctaaagactcatacggacttcgtgtacaccatcaaaattttgagaagcaataagaagccttgttagtgttttggagtcaaatatgactagatgtcatgtgtatgattgagtataagaactagaaccgcaaccgtttcccaaaagctaaagtagtgtttccttgttagaagctacaaagccaaagactcatacggacttcggctacaccatcaaagttttgagaagcaataagaagcttggttagtattttggagtaaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtaaaaaaagactatatctcatgtgtagtattgagtataaaaactagaaccgcaactggttcccaaaagcaaaagtagtgtttccttgttagaagatacaaagccaaagactcatacggacttcggctacaccatgaaaattttgagaagcaataagaagcttggttagtgttttggagtcaaatatgactagatgtcatgtgtatgattgagaataagaactagaatggcaaccgattcccaatagctaaagttatgtttccttgttagaagatacaaagccaaagactcatacggacttcgtgtacaccatcaaaattttgagaagcaataagaagcttggttagtattttagagtgaaatattacaggatatcatgtgtatcattgagtataagaactagaaccgcaaccgattcccaaaagctaaagtaatgtttcttgtttgtagatacaaatccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggacttcggctaagccattaatgttttgagaagcaataggaagcttagttatttttttggagtcaaatatgactagatgtcatgtgtatgattaagtataagaactagaaccgcaaccgattcccaaaagctaaagtaatgtttccttgtttgaagacacaaagtcaaagactcatacggacttcggctacaccatcaaaactttgtgaggcaataagaagcttcgttagttttttggagtcaaatacgactagatgtcatgtgtatgattaagtataagaactagaaccataactgattcccaaaagctaaagtaatgtttccttgttagaagatacaaagctaaaaactcatacggacttcggctaagccatcaaaattttgagaagcaataagaagcttggttagtgttttggagtcaaatatgactagatgtcatgtgtatgattgagtataagaactagaaccgcaaccgtttcccaaaagctaaagtagtgtttccttgttagaagctacaaagccaaagactcatacggacttcggctacaccatcaaagttttgagaagcaataagaagcttggttagtattttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtaaaaaacgactatatctcatgtgtagtattgagtataaaaactagaaccgcaactggttcccaaaagaaaaagtagtgtttccttgttagaagatacaaagccaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgtttgaagatacaaagccaaagactcatacggacttcgtgtacaccatcaaaattttgagaagcaataagaagcttggttagtattttagagtcaaatattacaggatatcatgtgtatattgagtataagaactagaaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgtaactaattcccaaaagctaaattaatgttgccttgttagaagatacaaagctaaaaactcatacggacttcggctaagccattaatgttttgagaagcaataggaagcttggttatttttttggagtcaaatatgactagatgtcatgtgtatgattgagtataagaactagaaccgcaaccgattcccaaaagctaaagtaatgtttccttgtttgaagacacaaagtcaaagactcatacggacttcggctacaccatcaaaactttgtgaggcaataagaagcttcgttagttttttggagtcaaatatgactagatgtcatgtgtatgattaagtataagaactagaaccataactgattcccaaaagctaaagtaatgtttccttgttagaagatacaaagctaaaaactcatacggacttcggctaagccatcaaaattttgagaagcaataagaagcttggttagtgttttggagtcaaatatgactagatgtcatgtgtatgattgagtataagaactagaaccgcaaccgtttcccaaaagctaaagtagtgtttccttgttagaagctacaaagccaaagactcatacggacttcggctacaccatcaaagttttgagaagcaataagaagcttggttagtattttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagactatatgtcatgtgtagtattgagtataaaaactagaaccgcaactggttcccaaaagcaaaagtagtgtttccttgttagaagatacaaagccaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgttagaagatacaaagccaaagactcatacggacttcgtgtacaccatcaaaattttgagaagcaataagaagcttggttagtattttagagtcaaatattacaggatatcatgtgtatcattgagtataagaactagaaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggactttggctaagccattaatgttttgagaagcaataagaagcttggttatttttttggagtcaaatatgactagatgtcatgtgtatgattgagtataacaactagaaccgcaaccttttcccaaaagctaaagtagtgtttccttgttagaagttacaaagccaaagaatcatatggaattcagctacaccatcaaagctttgagaagcaataagaagctttgttagttttttggagtcaaatatgacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttcgttagtgttttggagtcaaaaaagactatatgtcatgtgtagtattgagtataaaaactagaaccgcaactggttcccaaaagcaaaagtagtgtttccttgttagaagatacaaagccaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgtttgaagatacaaagccaaagactcatacggacttcgtgtacaccatcaaaattttgagaagcaataagaagcttggttagtattttagagtcaaatattacaggatatcatgtgtatattgagtataagaactagaaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgtaactaattcccaaaagctaaattaatgtttccttgttagaagatacaaagctaaaaactcatacggacttcggctaagccattaatgttttgagaagcaataggaagcttggttatttttttggagtcaaatatgactagatgtcatgtgtatgattgagtataagaactagaaccgcaaccgattcccaaaagctaaagtaatgtttccttgtttgaagacacaaagtcaaagactcatacggactttggctacaccatcaaaactttgtgaggcaataagaagcttcgttagttttttggagtcaaatatgactagatgtcatgtgtatgattaagtataagaactagaaccataactgattcccaaaagctaaagtaatgtttccttgttagaagatacaatgctaaaaactcatacggacttcggctaagccatcaaaattttgagaagcaataagaagcttggttagtgttttggagtcaaatatgactagatgtcatgtgtatgattgagtataagaactagaaccgcaaccgtttcccaaaagctaaagtagtgtttccttgttagaagctacaaagccaaagactcatacggatttcggctacaccatcaaagttttgagaagcaataagaagcttggttagtattttggagtcaaataagacaagatgttatgtgtttgattgagtataagaactataaccgcaacatcttcccaaaagctaaagttgtgtttcccttctagaagatacaaagccaaaaattcatacggactttggctacaccatcaaagctttaagaagcaacaagaagtttggttagtgttttggagtcaaaaaagactatatgtcatgtgtagtattgagtataaaaactagaaccgcaactggttcccaaaagcaaaagtagtgtttccttgttagaagatacaaagccaaagactcatacggacttcggctacaccatgaaaattttgagaagcaatatgaagcttggttagtgttttggagtcaaatatgactagatgtcatgtgtatgattgagtataagaactagaaccgcaaccgtttcccaaaagctaaagtagtgtttccttgttagaagctacaaagccaaagactcatacggacttcggctacaccatcaaagttttgagaagcaataagaagcttggttagtattttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtaaaaaacgactatatctcatgtgtagtattgagtataaaaactagaaccgcaactggttcccaaaagcaaaagtagtgtttccttgttagaagatacaaagccaaagactcatacggacttcggctacaccatgaaaattttgagaagcaataagaagcttggttagtgttttggagtcaaatatgactagatgtcatgtgtatgattgagaataagaactagaatggcaaccgattccctatagctaaagttatgtttccttgttagaagatacaaagccaaagactcatacggacttcgtgtacaccatcaaaattttgagaagcaataagaagcttggttagtattttagagtgaaatattacaggatatcatgtgtatcattgagtataagaactagaaccgcaaccgattcccaaaagctaaagtaatgtttcttgtttgtagatacaaatccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggactccggctaagccattaatgttttgagaagcaataagaagcttggttattttttttggagtcaaatatgactagatgtcatgtgtatgattgagtataagaactagaaccgcaaccgattcccaaaacctaaagtaatatttccttgtttgaagatacaaagtcaaagactcatacggacttcggctacaccatcaaaactttgtgaggcaataagaagcttcgttagttttttggagtcaaatatgactagatgtcatgtgtatgattaagtataagaactagaaccataactgattcccaaaagctaaagtaatgtttccttgttagaagatacaaagctaaaaactcatacggacttcggctaagccatcaaaattttgagaagcaataagaagcttggttagtgttttggagtcaaatatgactagatgtcatgtgtatgattgagtataagaactagaaccgcaaccgtttcccaaaagctaaagtagtgtttccttgttagaagctacaaagccaaagactcatacggacttcggctacaccatcaaagttttgagaagcaataagaagcttggttagtattttggagtcaaataagacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtaaaaaacgactatatctcatgtgtagtattgagtataaaaactagaaccgcaactggttcccaaaagcaaaagtagtgtttccttgttagaagatacaaagccaaagactcatacggacttcggctacaccatgaaaattttgagaagcaatatgaagcttggttagtgttttggagtcaaatatgactagatgtcatgtgtatgattgagtataagaactagaatggcaaccgattcccaatagctaaagttatgtttccttgttagaagatacaaagccaaagactcatacggacttcgtgtacaccatcaaaattttgagaagcaataagaagcttggttagtattttagagtcaaatattacaggatatcatgtgtatcattgagtataagaactagaaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggacttcggctaagccattaatgttttgagaagcaataggaagcttggttatttttttggagtcaaatatgactagatgtcatgtgtatgattgagtataagaactagaaccgcaaccgattcccaaaagctaaagtaatgtttccttgtttgaagatacaaagtcaaagactcatacggacttcggctacaccatcaaaactttgtgaggcaataagaagcttcgttagtttttgggagtcaaatatgactagatgttatgggtttgattgagtataagaactagaaccgcaacatcttcccaaaagctaaagttgtgtttcccttctagaagatacaaagccaaaaactcatacggactttggctacaccatcaaagctttaagaagcaacaagaagtttcgttagtgttttggagtaaaaaaagactatatgtcatgtgtagtattgagtataaaaactagaaccgcaactggttcccaaaagcaaatttagtgtttccttgttagaagatacaaagccaaagacacatacggacttcggcaacaccatgaaaattttgagaagcaataagaagcttggttagtgttttggagtcaaatatgactagatgtcatgtgtatgattgagtataagaactagcatggcaaccgattcccaatagctaaagttatgtttccttgttagaagatacaaagccaaagactcatacggacttcgtgtacaccgtcaaaattttgagtagcaataagaagcttggttagtattttagagtgaaatattacaggatatcatgtgtatcattgagtataagaactagaaccgcaaccgattcccaaaagctaaagtaatgttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaagactcatacggacttcggctaagccattaatgttttgagaagcaataggaagcttggttatttttttggagtcaaatatgactagatgtcatgtgtatgattgagtataagaactagaaccgcaaccgtttcccaaaagctaaagtagtgtttccttgttagaagctacaaagccaaagactcatacggacttcggctacaccatcaaagttttgagaagcaataagaagcttggttagtattttggagtcaaataagacaagatgatatgtgtttgattgagtataagaactataaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagactatatgtcatgggtagtattgagtataaaaactagaaccgcaactggttcccaaaagcaaaagtagtgtttccttgttagaagatacaaagccaaagactcatacggactttggctacaccatcaaagttttgagaagcaataagtagcttggttagtattttggagtcaaataagacaagatgttatgtgtttgattgagtataagaactataaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagactatatgtcatgtgtagtattgagtataaaaactagaaccgcaactggttcccaaaagaaaaagtagtgtttccttgttagaagatacaaagccaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgtttgaagatacaaagccaaagactcatacggacttcgtgtacaccatcaaaattttgagaagcaataagaagcttggttagtattttagagtcaaatattacaggatatcatgtgtatattgagtataagaactagaaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccacaactaattcccaaaagctaaattaatgtttccttgttagaagatacaaagctaaaaactcatacggacttcggctaagccattaatgttttgagaagcaataggaagcttggttatttttttggagtcaaatatgactagatgtcatgtgtatgattgagtataagaactagaaccgcaaccgattcccaaaagctaaagtaatgtttccttgtttgaagacacaaagtcaaagactcatacggacttcggctacaccatcaaaactttgtgaggcaataagaagctttgttagttttttggagtcaaatatgactagatgtcatgtgtatgattaagtataagaactagaaccataactgattcccaaaagctaaagtaatgtttccttgttagaagatacaaagctaaaaactcatacggacttcggctaagccatcaaaattttgagaagcaataagaagcttggttagtgttttggagtcaaatatgactagatgtcatgtgtatgattgagtataagaactagaaccgcaaccgtttccaaaaagctaaagtagtgtttccttgttagaagctacaaagccaaagactcatacggacttcggctacaccatcaaagttttgagaagcaataagaagcttggttagtattttggagtcaaataagacaagatgttatgtgtttgattgagtataagaactataaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagactatatgtcatgtgtagtattgagtataaaaactagaaccgcaactggttcccaaaagaaaaagtagtgtttccttgttagaagatacaaagccaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgtttgaagatacaaagccaaagactcatacggacttcgtgtacaccatcaaaattttgagaagcaataagaagcttggttagtattttagagtcaaatattacaggatatcatgtgtatattgagtataagaactagaaccgcaaccgattcccaaaagctaaagtaatgtttcttgtttgtagatacaaagccaaagactcataccgacttcggctacaccatcaaagctttgtgaggcaataagaagcctggttagtttttcggaatcaaatatggctagatgtcatgtgtatgattgagtataagaactagaaccgtaactaattcccaaaagctaaattaatgttgccttgttagaagatacaaagctaaaaactcatacggacttcggctaagccattaatgttttgagaagcaataggaagcttggttatttttttggagtcaaatatgactagatgtcatgtgtatgattgagtataagaactagaaccgcaaccgattcccaaaagctaaagtaatgtttccttgtttgaagacacaaagtcaaagactcatacggacttcggctacaccatcaaaactttgtgaggcaataagaagctttgttagttttttggagtcaaatatgactagatgtcatgtgtatgattaagtataagaactagaaccataactgattcccaaaagctaaagtaatgtttccttgttagaagatacaaagctaaaaactcatacggacttcggctaagccatcaaaattttgagaagcaataagaagcttggttagtgttttggagtcaaatatgactagatgtcatgtgtatgattgagtataagaactagaaccgcaaccgtttcccaaaagctaaagtagtgtttccttgttagaagctacaaagccaaagactcatacggacttcggctacaccatcaaagttttgagaagcaataagaagcttggttagtattttggagtcaaataagacaagatgatatgtgtttgattgagtataagaactataaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagactatatgtcatgtgtagtattgagtataaaaactagaaccgcaactggttcccaaaagaaaaagtagtgtttccttgttagaagatacaaagccaaagactcatacggactttggctacaccatcaaagttttgagaagcaataagtagcttggttagtattttggtgtcaaataagacaagatgttatgtgtatgattaagtataagaactttaaccacaactgattcccaaaagctaaagtaatgtttccttgttagaagatacaaagctaaaaactcatacggacttcggctaagccatcaaaattttgagaagcaataagaagcttggttagtgttttggagtcaaatatgactagatgtcatgtgtatgattgagtataagaactagaaccgcaaccgtttcccaaaagctaaagtagtgtttctttgttagaagctacaaagccaaagactcatacggacttcagctacaccatcaaagttttgagaagcaataagaagcttggttagtgttttggagtaaaaaaagactatatgtcatgtgtagtattgagtataaaaactataaccgcaattggttcccaaaagcaaaagtagtgtttccttgttagcagatacaaaggcaaagactcatacggacttcggctacaccatcaaagttttgagaagaaataagaagcttggttagtattttggagtcaaataagacaagatgttatgtgtttgattgagtataagaactagaaccgcaacattttcccaaaagctaaagttgtgtttcccttctagaagatacaaagccaaaaactcatacggactttggctacaccatcaaagctttaagaagcaacaagaagtttcgttagtgttttggggtcaaaaaagactatatgtcgtgtgtagtattgagtataaaaactagaaccgcaactggttcccaaaagcaaaagtagtgtttccttgttagaagatacaaagccaaagactcatacggacttcggctacaccatgaaaattttgagaagcagtaagaagcttggtaagtgttttggagtcaaatatgactagatgtcatgtgtatgattgaatataagaactagaatggcaaccgattcccaatagctaaagttatgtttccttgttagaagatacaaagccaaagactcatacggacttcgtgtacaccatcaaaattttgagaagcaataagaagcttggttagtattttagagtcaaatattacaggatatcatgtgtatcattgagtataagaactagaaccgcaaccgattcccaaaagctaaagtaatgtttcttgtttgtagatacaaagccaaagactcataccgacttcggctacaccatcaaagcattgtgaggcaataagaagcttagttagtttttcggaatcaaatatggctagatgtcatgtgtatgattgagtataagaactagaaccgcaactaattcccaaaagctaaattaatgtttccttgttagaagatacaaagctaaaaactcatacggacttcggctaagccatcaaaattttgagaagcaataagaagcttggttagtgttttggagtcaaatatgactagatgtcatgtgtatgattgagtataagaactagaaccgcaaccgtttcccaaaagctaaagtagtgtttccttgttagaagctacaaagccaaagactcatacggacttcggctacaccatcaaagttttgagaagcaataagaagcttggttagtattttggagtcaaataagacaagatgatatgtgtttgattgagtataagaactataaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagactatatgtcatgtgtagtattgagtataaaacctagaaccgcaactggttcccaaaagcaaaagtagtgtttccttgttagaagatacaaagccaaagactcatacggacttcggctacaccatgaaaattttgagaagcaataagaagcttggttagtgttttggagtcaaatatgactagatatcatgtgtatcattgagtataagaagtagaaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatatggacttcggctaagccattaatgttttgagaagcaataagaagcttggttatttttttggagtcaaatatgactagatgtcatgtgtatgattgagtataagaactagaaccgcaaccgtttcccaaaagctaaggtagtgtttccttgttagaagttacaaagccaaagaatcatatggaattcagctacaccatcaaagctttgagaagcaataagaagctttgttagttttttggagtcaaatatgacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttcgttagtgttttggagtcaaaaaagactatatgtcatgtgtagtattgagtattaaaactagaaccgcaactggttcccaaaagcaaatttagtgtttccttgttagaagatacaaagccaaagacacatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgttagaagatacaaagccaaagactcatacggacttcgtgtacaccatcaaaattttgagaatcaataagaagcttggttagtactttagagtgaaatattacaggatatcatgtgtatcattgagtataagaactagaaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggacttcggctaagccaataatgttttgagaagcaataagaagtttggttatttttttggagtcaaatatgactaaatgtcatgtgtatgattgagtataagaactagaaccgcaatcgtttcccaaaagctaaagtagtgtttccttgttagaagttacaaagccaaagaatcatatggaattcagctacaccatcaaagctttgagaagcaataagaagctttgttagttttttggagtcaaatatgactagatgtcatgtggatgattaagtataagaactagaaccgcaaccggttcccgaaagctaaagtaatgtttccttgttagaagatttaaagccaaagactcatacggacttcggctacaccatcaaagttttgagaagcaataagaagcttggttagtattttggagtcaaataagacaagatgttatgtgtttgattgagtataagaactagaaccgcaacatttttccaaaagctaaagtaatgtttcccttctagaagatacaaaacaaaaacctcatacggactttgggtacacaatcaaagctttaagaagcaacaagaagtttggttagtgttttggattcaaaaaaagactatatgtcatgtgtagtattgagtataagaactagaaccgcaactggttcccaaaaggtaaagtagtgtttccttgttagaagaaacaaagccaaaggctcatacggtcttcgcctacaccatgaaaattttgagaagcaataagaagcttggttagtgttttggagtcaaatacgactagatgtcatgtgtatgattgagtataagaactagaaccgcaaccgattcccaaaagctaaagtaatgtttccttgtttgaagaacaaagccaaagactcatacagactttggctacacaatcaaagctttgtgaggcaataggaagcttggttagttttttggagtcaaatatgactagatgtcatgtggatgattgagtataagaactagaaccgcaaccggtttccaaaggctaaagtagtgtttccttgttacaagatacaaagccaaagactcatacggacttcggctacaccatcaaagctttgagaagtaataagaagcttgcttagtattttggagtcaaataagacaagatgttatgtgtttgattgagcataagaactagaaccgcaacatcttcccaaaagctaaaatagtgtttcacttctagaggatagaaagccaaaaactcatagagacatctactacaccatcaaagctttaagaagcaacaagaagtttggttagtaatttggagtcaaataagactatatgtcatgtgtagtattgagtataagaactagaaccgcaaccggttcccaaaagcaaaagtagtgtttccttgtcaaaagatacaaagccaaagactcatacggacttcggctacaccatgaaagttttgagaagcaataagaagcttggttagtgttttggaatcaaatatgactagatgtaatgtgtatgattgagtataagaactagaacggcaaccgattcccaatagctaaagttatgtttccctgttagaagatacaaagccaaaaactcatacggacttcggatacaccatcaaaattttgagaagcaataagaagcttggttagtattttagagtcaaatattacaggatgtcatgtgtatcattgagtataagaactagaaccgcaaccaattcccaaaagctaaagtaatgtttccttgtttgaagatacaaaaccaaagagtcatacggacatcggctacaccatcaaagctttgtaaggcaataagaagcttggttagttttttggagtcaaatatgactagatgtcatgtgtatgattgagtataagaattagaacggcaaccgattcccaatagctaaagttatgttttcttgttagaagatacaaagccaaagactcatacggacttcggatacaccatcaacattttgagaagcaataagaagcttggttagtattttggagtcaaatattacaggatgtcatatgtatcattgagtataagaaatagaacctcaaccgattcccaaaagctaaagtaatgtttccttgttggaagatacaaagccaaagactcatacggactttggctacaccatcaaagctttgtgaggctataagaagcttggttagtttttcggagtcaaatatgactagatgtcatgtgtatgattgagtataagaactagaatcgcaaccgtttcccaaaagctaaagtagtgtttccttgttagaagatacaaagccaaagaatcataaggacttcagctacaccatcaaagctttgagaagcaataagaagtttggtgagtgttttggagtcaaatatgactagatgtcatgtgtatgattgagtataagaactagaatcgaacccattttccaaaagctaaagtagtgtttccttcttagaagatacaaagcaaaagaatcatatggacttcagccacaccatcaaagctttgagaagcaataagaagctatgtcagctttttggagtcaaatatgactagatgtcatgtggatgattgagtataagaactaaaaccgcaactggttcccaagggctaaagtagtgttagaagatacaaagccaaagactcatacagacttcggctacaccatcaaagctttgagaagcaataagaagcttgcttagtattctggagtcaaataagacaatatgttatgtgtttgattgagcataagaactataaccgcaacatcttcccaaaagctaaaatagtgtttcacttcttgaagataaaaagccaaaaactcatacagacttctgctacaccatcaaagctttaagaagcaacaagaagtttggttagtattttggagtcaaataagactatatgtcatgtgtagtattgagtataagaactagaaccgcaaccggttcccaaaagcaaaagtagtgtttccttgtcagaagatacaaagccaaagactcatacggacttcggctacaccatgaaagttttgagaagcaataagaagcttggttagtgttttggaatcaaatatgactagatgtcatgtgtatgattgagtataagaactagaacggcaaccgattcccaattgctaaagttatgtttccctattagaagatacaaagccaaaaactcatacagacttcggatacaccatcaaaattttgagaagcaataagaagattggttagtattttaaagtcaaatattacaggatgttatgtgtatcattgactataagaattagaaccgcaaccgattcccaaaagctaaagtaatgtttccttgttcaaagatacaaagccaaagactcatacggacttcggctacaccatcaaagctttgtgacgcaataggaagcttggttagtttttcggagtcaaatatgactagatgtcatgtgtacgattgagtataagaactagaaccgcaactgattcctaaaaactaaagtaatgtttctttgttagaagatacaaatctaaaaactcatacggacttcggctaagccatccaagttctgagaagcaataagaagcttggttaatgttttggagtcaaatatgactagatgtcatgtgtatgattgagtataagaactagaaccgcaaccgtttcccaaaagctaaagtagtgtttccttgttagaagatacaaagccagagaatcataaggacttcagctacaccatcaaagctttgagaagcaataagaagctatgtcagctttttggagtcaaatatgactagatgtaatgtggatgattgagtataagaactaaaaccgcaactggttcccaagggctaaagtagtgtttccttgttagaagatacaaagccaaagactcatacggacttcggctacaccatcaaagctttgagaagcaataagaagcttgcttagtattttggagtcaaataagacaatatgttatgtgtttgattgagcataagaactagaaccgcaacatcttcccaaaagctaaaatagtgtttcacttcttgaagataaaaagccaaaaactcatacagacttctgctacaccatcaaagctttaagaagcaacaagaagtttggttagtattttggagtcaaataaaagtatatgtcatgtgtagtattgagtataagaactagaaccgcaaccagttcccaaaagcaaaagtagtgtttccttgttagaacatacaaagccaaagactcaaacagactttgggtacaccatgaaaattttgagaagcaataagaagcttggttagtgttttggagtcaaatatgactagatgtcatgtgtatgattgagtataagaactagaacggcaaccgattgccaatagctaaagttatgtttccttgttagaagatacaaagccaaagactcatacggacttcggatacaccatcaaaattttgagaagcaataagaagcttggttagtattttagagtcaaatattacaggatgtcatgtgtatcattgagtataagaactagaaccgtaaccaattcccaaaagctaaagtaatgtttccttgtttgaagatacaaaaccaaaggctcatacggacatcggctacaccatcaaagctttgtgaggtaataagaagcttggttagttttttggagtcaaatatgactagatgtcatgtgtatgattgagtataagaactagaaccgcaaccgtttcccaaaacctaaagtaatatttccttgtttgaagatacaaagtcaaagactcatacggacttcggctacaccatcaaaactttgtgaggcaataagaagcttcgttagttttttggagtcaaatatgactagatgttatgtgtttgattaagtataagaactagaaccacaactgattcccaaaagctaaagttgtgtttcccttctagaagatacaaagctaaagactcatacggacttcggctacaccatgaaaattttgagaagcgataagaagtttggttagtgttttggagtcaaaaaagactagatgtcatgtgtagtattgagtataaaaactagaaccgcaaccgattcccaatagctaaagttatgtttccttgttagaagatacaaagccaaagactcatacggacttcggctacaccatcaaaattttgagaagcaataagaagcttggttagtattttagagtcaaatattacaggatatcatgtgtatcattgagtataagaactagaaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggactttggctaagccattaatgttttgagaagcaataagaagcttggttatttttttggagtcaaatatgactagatgtcatgtgtatgattgagtataagaactagaaccgcaaccgtttcccaaaagctaaagtagtgtttccttgttagaagttacaaagccaaagaatcatatggaattcagctacaccatcaaagctttgagaagcaataagaagctttgttagtttttcggagtcaaatatgacaagatgttatgtgtttgattgagtataagaactagaaccgcaacatcttcccaaaagctaaagttgtgtttcccttctagaagatacaaagccaaaaactcatacggactttggctacaccatcaaagctttaagaagcaacaagaagtttggttagtgttttggagtcaaaaaagactatatgtcatgtgtagtattgagtataaaaactagaaccgcaactggttcccaaaagcaaaagttatgtttccttgttagaagatacaaagccaaagactcatacggacttcggctacaccatgaaaattttgagaagcaataagaagcttggttagtgttttggagtcaaatatgactagatgtcatgtgtatgattgagtataagaactagaatggcaaccgattcccaatagctaaagttatgtttccttgtttgaagatacaaagctaaagactcatacggacttcgtgtacaccatcaaaattttgagaagcaataagaagccttgttagtgttttggagtcaaatatgactagatgtcatgtgtatgattgagtataagaactagaaccgcaaccgtttcccaaaagctaaagtagtgtttccttgttagaagctacaaagccaaagactcatacggacttcggctacaccatcaaagttttgagaagcaataagaagcttggttagtattttggagtaaaataagacaagatgttatgtgtttgattgagtataagaactagaaccgcaacatcttcccaaaagctaaagttgtgtttcctttctagaagatacaaagccaaaaactcatacggactttggctacaccatcaaagctttaagaagcaacaagaagtttggttagtgttttggagtaaaaaaagactatatctcatgtgtagtattgagtataaaaactagaaccgcaactggttcccaaaagcaaaagtagtgtttccttgttagaagatacaaagccaaagactcatacggacttcggctacaccatgaaaattttgagaagcgataagaagcttggttagtgttttggagtcaaatatgactagatgtcatgtgtatgattgagaataagaactagaatggcaaccgattcccaatagctaaagttatgtttccttgttagaagatacaaagccaaagactcatacggacttcgtgtacaccatcaaaattttgagaagcaataagaagcttggttagtattttagagtgaaatattataggatatcatgtgtatcattgagtataagaactagaaccgcaaccgattcccaaaagctaaagtaatgtttcttgtttgtagatacaaatccaaagactcataccgacttcggcgacaccatcaaagctttgtgaggcaataagaagcttggttagtttttcggaatcaaatatggctagatgtcatgtgtatgattgagtataagaactagaaccgcaactaattccgaaaagctaaattaatgtttccttgttagaagatacaaagctaaaaactcatacggactccggctaagccattaatgttttgagaagcaataagaagcttggttattttttttggagtcaaatatgactagatgtcatgtgtatgattgagtataagaactagaaccgcaaccgtttcccaaaacctaaagtaatatttccttgtttgaagatacaaagtcaaagactcatacggacttcggctacaccatcaaaactttgtgaggcaataagaagcttcgttagttttttggagtcaaatatgactagatgttatgtgtttgattaagtataagaactagaaccacaactgattcccaaaagctaaagttgtgtttcccttctagaagatacaaagccaaaaattcatacagactttggctacaccatcaaagctttaagaagcaacaagaagtttggttagtgttttggagtcaaaaaagactatatgtcatgtgtagtattgagtataaaaactagaaccgcaactggttcccaaaagcaaaagtagtgtttccttgttagaagatacaaagccaaagactcatacggacttcggctacaccatgaaaattttgagaagcaagaagaagcttggttagtgttttggagtcaaatatgactagatgtcatgtgtatgattgagtataagaactagaatggcaaccgattcccaatagctaaagttatgtttccttgttagaagatacaaagccaaagactcatacggacttcgtgtacaccatcaaaattttgagaagcaataagaagcttggttagtattttagagtgaaatattacaggatatcatgtgtatcattgagtataagaactagaaccgcaaccgattcccaaaagctaaagtaatgtttcttgtttgtagatacaaagccaaagactcataccgacttcggctacaccatcaaagctttgtgaggcaataagaagcttggttagtttttcggaatcaaatatggctagatgtcatgtgtatgattgagtataagaactagaaccgcaactaattcccaaaagctaaattaatgtttccttgttagaagatacaaagctaaaaactcatacggactttggctaagccattaatgttttgagaagcaataagaagcttggttatttttttggagtcaaatatgactagatgtcatgtgtatgattgagtataagaactagaaccgcaaccggttgccaaaagctaaagtagtgtttccttgttagaagatacaaagctagagactcatacgaatttcggctacaccatcaaaactttgagaagcaataagaaatttggtaagtgttttggattcaaatatgactatatgtcatgtgtatgattgagtataagaactataaccgcaaccggttcccaaaagctaaaatagtgtttccttattagaagatacaaagccaaagactcatacggacttcggctacaccatcaaaactttgagaagctagaagaagcttgtttagggggtgttattcgttaatggattttaatagaattgaaatccaagccgaatccactgttattcaactaatgattctatatccaactttaaaatttagtgttattggaactcatctttgtaaatcatgcttaatagattttaaagtttgatgttattcaattaagattttaaatatttcattaaaatccagcgttattaaaaactaaaagacttgtaaaatctttgtatattaattcatttgaaatgaaacctctttggagtttcatgagtaaatcactagaatcaaaatccaagacatattgcagagattttaaaattcatacaaacatattcttaaaagcaatatcagaaaacaagtctaaagctttaagaattgactttaactccataattgaataacaccaccttagtgtttaggattcaaatacaactagatgtcatgtgtatgattgcgtataagaactagaaccgcaactagttcttgaaaacctaagtatatttccttgttacatgatacaaaccaaagactcatacggactacagcttcagcatcaaagctttgaaaagcaagaagaagcttggttagtgttttgaagccacatacgactacttgtcatgtgtatgattgagtataagaactagaaacgcaactggttcccaaaagccaaagtagtgtttccttgtttgaagatacaaatccaaagactcatactgactttggcaacaccaacaaagctttgacaagcaagaaaaagcttggatagtgttttagagtcaaagcttggatagtgtactagatgtcatgtgtatgattgagtataagaactagaatcgtagtcggttcccaaaagataaagtattgtttccttgttagaagatacaaagccaaagactcatacggaattcggctacaccatgaaaatatttagaagcaataagaagcttggttagtgttttggagtcaaaatgactagatgtcatgtgtatgattgagcataagaacttgaacggcaaccgattcccaatagctaaagttatgtttccttgttagaagatacaaagccaaagactcatacggtcttcggatacaccatcgaaattttgagaagcaataagaagcttggttagtattttgaagtcaaatattacatgatgtcatgtgaatcattgagtataagaactagaaccgcaaccaattcccaaaagcgaaagtaatgtttcctttataaaagatacaaatccaaagacttatacggactttggctacaccataaaagttttgggaagcattaagaagcctagttagtgttatggagtcaaaataagacaatatgtcgtgtgtatgattgagtataagaactagaaccgcaactgattcccaaaagctaaagtaatgtttccttgtttgaagatacaaagctaaatacacatacggacttcggctacaccatcaaagcttggagaagcaataagaaacttggttagttattcgaagtcaaatatgactagatgttatgtttatgattgagtataagaactagaaccgccatcgattcccaaaagctaaagtaatgtttccttgttaaaagatacaaatccaaagacttatacaaacttcggctacaccatcaaagtattgcgtagcaataagaagcttggttagtattttggagtcaaatatgacttgatgtcatgtggatgattgtttataagaactagaaccgtaaccggttcccaaaagcaaaagtattgtttcctgttagaagatacaaagccaaagactcatacggacttcggctaagccatcaaagttttgagaagcaataagaagcttggttagtgttttggagtcaaatatgacttgatgtcatgtgtatgattgagcataagaactaaaaccgcaactggttcccaaaagctaaagtagtgtttccttgttagaagatacaaagatagagactcatacggatttcggctacaccatcaaaactttgagaagcaataagaaatttggtaagtgctttggattcaaatatgattatatggcatgtgtatgattgagtataagaactataaccgcaaccggttcccaaaagctaaaatagtgtttccttattagaagatacaaagccaaagactcatatggacttcggctacaccatcaaatctttgagaaactagaagaagcttgtttagtgtttaggattcaaatataactagatgtcatgtgtatgattgcgtataagaactagaatcgcaactagttcttgaaaacctaagtatatttccttgttacatgacacaaaccaaagactcatacggactacagcttcagcatcaaagctttgaaaattaagaagaagcttggttagtgttttgaagtcagatatgactacttgtcatgtgtatgattgagtataagaactagaaacgcaactggttcccaaaagccaaagtagtgtttccttgtttgaagttacaaatccaaagacacatacttactttggcaacaccatcaaagctttgagaagcaagaagaagcttggatagtgttttagagtcaaatatgactagatgtcatgtgtatgatggagtataagaactggaatcgcagtcggttcccaaaagataaagtattttttccttgttagaagatacaaagccaaagactcatacggacttcggctacaccatgaaaatattgagaagcaataagaagcttggttagtgtttcggagtcaaatatgactatatgtcatgtgtatgattgagtagaagaactagaaccgcaactggttcccaagagataaagtattgtttccttgttagaagatacaaagccaaagactcatacaaacttcgactacaccatcaaagctttgagaagcaataagaagcttggttagtgttttggattcaaatatgactatatgttatgtgtatgattgagtataagaactagaaccggaaccggttcccaaaggttcaagtagtgtttccttgttagaagatacaaagccaaatactcatagggactttggcttcaccataaaagttttgagaagcaataagaagcttggttagtgttttgtagtcaactatgactagatgtcagttatatgattgaggataagacctagaatcacaaccggttcctaaaagttaaagtattgtttccttgttagaagatatgatagtaggatttttctcaattaatcgtaaaacactatcctgtcgttgtagtattttaagatgtcaatccaatccggtgtgatgcaaacagatgagatatgattagaaagctctaagtcaagccaagtagagagtcggttggttctaacagtcctagtatgcaataacagaaatgaaatgaaactaaaagcagaaatggcaatagtaggcaggtaaataacaaagcagaaatgataactggcaatcaaatggatatacgattcttaaggatggggtaatcgaatagtatggtctccttaatctatttaggtggttgacaaaatttcacggttatccctagacaataagttcaacaacaaattaattcactcccgtgatagaaatcctcaagcaaagctagacactgatctaattcccattagcgatctctaactaagtaggtattatcgaatcaacatgttaaagccaataccctatctacaaccaatcccttggggtagagtcagatatctctggaattaataggatccaacgcccattaaacgccagaagggattctagtattctaaactcaaccacctaaaacgaccaagtaaaccacaactaatctattccatcctcagaaatacagttcactactcagacataatcaaagacaatagcaaaacaacgattgaaaacattataacagaaatgatgaaagacttagacgaaaactgaatatcaaatacttgaaagtgaaaatacaaagtcgcaggaaaacactgcggctatgaaagttgcaaaaaagacaagataataacggatgccttcgggaaaaccctaagaggcagtttatgtaagcgagaaatgaaacaaataaggaaactagatatatagcgaatcttcacgtcatgaccctgcgaccgaatgtgtcattggcatctgatgggctgaaatgagcttccatgtgatcgagtatgtcattgatcaaactgggcttcaggggcttcgccttgcgatcgagtgagatgcagtgaagtcgagattgaatggtccaacgaccctgtgatcgagtgcgatcgagtgaatgtcatgaggtggtgatcgagtggttctgatggggtgattcctccggcttcgcgattgagtgaaactgagctgctagcttctccggggttgcgatagagtgatttgccctggcacggctccgaggctgcgatagagtacttttgccgaaggtgtcattgggctttctgactttctgttatgtttctcctctgtttgaactcaaaacgcatccaaagtacctgaaaacaaccaaatatgcaatgcacatgcaatcctaatgcaaaatcgtccttagtatgcagaacacactaaaactactcctaatgagattaaatgtggacgaaacaatgacaaagtggtgaagaatgaatgcctaaatcatgcaaagtatagacatatcaactcccccaaacttagtctttgcttgccctcaagcaaacaagaagacataagcggaaggagaggtttgaagttggggattcagaaccaaagcatgagatatgacaattaagatcaatgtaccagctaacagttctaagatgcgaggtgatcgacttttacataaaaactttagccattctctgttatgatccaaacctacactcaaatgcacaatgcgtcaaaaacatgaatcaagatatgcatcgctagtgaacgcatttggctagtgacaggttatgagacaaagatagtcccttttaagtggttcagatttttatagcaggggactctcaatgaaaaaggaccgagctttagaagaatgctaaaggtaagtgccaacctatgcatacaagaatagcatcccatctacccaatgacataaaccgtgaataacaagaagatggtcctatctctaaacccaatgatgatcctaagtctacccttttgcaccaaaggcatatttcgatttttttcttggatcaatgtttccttttcttttctttagctcttgttcttaaggagaagcttttcttaaactctatgagtctagtctaatgaattggatttttcttaaactcttatggctcttatcatttatttttatttttttcttttctgtttttgctgccatctcttttttttagagcatatcttaacaattttatgcttcccaaacatttactagacctcaatatgatttttagcttccttctcctaaagactctaacccattttttctttctttttcttttcacactcaatccctatccccaaataagttcccacctagtcctactaagtccaaatatacggattggaactacatgagatactactcttgtcggctcaaacctaacacgttctaccaagctcaatcctgaaaataggcctcacatgctctcataaaataacatggcttgaaagaaggattggttaagggtgaactactccaataatagaagcagctacttggattaacaagagtggtgaataagtgaaagaaaatccaaatatgtattctatccacgagttcaaaaacgatgcaaacatgataattataagtcagattcaagttcaaattgacagggaaaaggtgtcatgacatgcatcgagtggtgtctatagaacatggtgcggttttacttcaaagtcattcaaatgccttagagaactaataactcattttagtgaatcatcatgcttcaaggctaattcctcattatcccctatgcatatgcaacaatcctatatgaaacactctaaactctatcctaaatgtaatgcaactaaatgatcactctgtttatgtggaattcattttcaaaaaaattcaattttttttttgttttttctctatgacttagatgatatgcagagtcaaatgatattcacaaaaacaagtcaaatacgtcttgaaccctcccccaaacttaaattacacagtcccttgtgtaatcaaaatttgtgaaagaattcaagataaacacagaaaaacaaaaacaaaagcggtatttacaaagggttttagtgtgttacctcagtaggcatgaccggttcttggtgtggctccgccatctcctcgtcattgtgctcgatcgcaacccgagcaggttgtgcagcacgtcgctcatgtgttctccgacccgacattatccaacccttgcttgatgatcggaccatcctagcgctcttccgcctcttgtgctccattggctcatgagactcgtgccttacgggaacttgcagaacggtgtggtccctctgttgataggtggattgcctttgtagggcaatattatggcagctggatggcatgtcttcaggcgggttatcattgaagtcctgacgggcgttttcacttctccttgcgattgagtggtttgggcaattccactagaagaccactcaatcacaccacttccatgttgcgatcgagtagattgacattgtcgttgagaaagatgttgtcccaaaaccactagatcgcactctcgagcttttactctcatcttgcgatcgagtgattcatcaaaaaaaaattgaatttttttatttgaacactcggttgcatccctgatgttgctccagctgttattcatttcctgagaatcaaaaccaaaaccaaaacaaatcaaaagtaactaaataaaataaaaactatatacagggataagcatggaacttcctcccaagtgagcttgttttaagtctctagcttgactcctcacactcattaggctcaaggaggatgatagagtagaattgacgtctcctctccttccttagtagatacaacatcaaattcagcatgctcccgtgacaggtctataattgagtactcaatggccctttcttcgtaagctcctttttcatcatctggatagtcgtcttttctagactgttctaatgtgaattcacatccttcttttctaaccataggaataacttcatcatttgggacgtccttgatgtcgagtggtgcttggttggctttcccatggagctccttgacttgatccttcagctctttcacagtgtgtgttagctctcttatagctctgtcgtgccatttagacctctccttgagttctagccaatcatttgatgccctcatgcttgactttagctgtttggttgagcactctagtcgaatatcaattgagccttcctcgttcaatgcaacatcctctctttctaacgcaatgacacctttaaagatctctgatcctggtactttgttgtgtgagtctaatgacatctcatagctcaaggtctcactggagagaaatccagcttcactacttttgatcacaggagtttgaaggtgatctttgttagtaagctcctctagcagttcattagctagctgacccatttcttcaactaagaaggtttgtccttctattgttggcttcttcatagtgtccctgatttcatagttcattttgaaatcctcccccatattaagattaatttttccttgcttaacatctatgactgctccagttgaagccaagaaaggtcttcctaagatcagaggatccttagattcttcatccatctcaagcacaacaaaatcagtagggacctctactccattaatcattactgacacatcctctaacttgccaaaaggtctccttgaactcctatcagcaagaatcaaggttaggtcacaaggcttgtagtgaacgaaacccagcttccttgccacagagagtggcattatgctgactgaggctcctagatcacaaagataattgctgaaaggcaattgcctaatggagcatggtagagtaaaagatcctggatcttccaacttttcttgaacaatcttcttgcactgcactcatgacttaataccaccattccttggacttctttgatcctttctataattaggtctttcacgtacttgtgctcgtcaggtattagcgcgagacaatccactaaaggcatatcctttatctgtttttccaatagggctcaatatttcgcaaccagaactttcttaaatcgaccagggaatggaagtggaggtttttaaggcggtggcacgaagactgtatctttggtctttgcagctgtcggttttgcaacgaaggtagtagctagcggagcttgtggtcgagtgcgatgactgtcaaggatgggctctttgattgttttgtcagccaaaacatcatcttgataaaaatcctccccctctagaataacactgtcctcagtgtttgaggtagggacatgtcgagttggcagctctcgatcatgtctgatagtgatggcatgggcagtggcatactcctttggattcatgattgctttgcctgaaagctggcatgggttgttgttaacagatggtgaagcgaggatgccttccacatatctcatcctagtgctcattgattcgaacttgctgttaagttcgacaccttgtccgtcgactttgttgtttaattcagccagcttcttagcgatttccattgctcatgtggcttgtccttgaatgagctgctggagcatagtcattatgtctgaattctgaggcgcaggtgcttgttgttgatgtggtgtgaaaccaggttgtggctgctgttgttgatatcctccttgaaactgctgctttggaacgaacccttggctttggttataaggaacaaacggttttggttggttctgctgttgttgctgctggggataaacttggttttgagggttggcgacattggtgcttctgtatgacagatttggattgggtctgtaattgttgtaccctatgttgtagccaccttgattctgaacatagctgatttcggcacactcattagtctcccccacttggatttggaatacttcgtcttcagagacgaagtgaacatgcttctgctgcacttggaggagtttgctgattttttcattgagagctttaatctctcggtggtgcttgtcatcagattcagtactggtgtggatgcttctttcataatcttcattgtaattgccatccgtctgagcaaagttttcaactagctcccatccttcttcaacatccttcttcaggaaattcccatttgaagcggtgtcaaagagcattcgtatcttaggcaggacacctctataaagtgggctgagaagagaagctttcttaaatccatgatgagggcatttggtttgataacccttaaagcgctcccaagcttcaaagaatctttcattttgcttctgagtgaatccggatatctcattccggagttggaaaagtattttgccaagaaggcctttttgcagtcatcccaggtcgtgattgaattctggggtagcgtcttttcccacagatgggcttcaactccaagtgagaatggaaacaagcgaagcttgaaaccatcttcactaactccattgattttagtaaggccacggagcctttcaaacttgtcaagatgatctagcggatcctccattggttggccatgaaacttgttcccctgaactattgcaatgagaccgcttttgatctcaaagttcttgttctgtactagaggtggaacaattccatgacgctggtcgtggttatgagggaagtcaccagcaccaacgttggtaggttgctcttgctcatctacaacgtcagccattgtgtcggtttctgtctgttctatcagttggcgagcaatacggtcgatgttattgttgaataggaggttctgatttccttgtgaccgtgtatgcatgcaacatatagcagccgtgctataacagatgaatcaaagatgcgtctgtaaagcgggttgcaaggtacctgaaacacaaagacagaaaaggcacaatgttagtaacttgtgtaacaaaaccgaacttgatcttaacgtttctaatgatctcaaatataacaaacaaacacgaaactggcaacggcgccaaattgatagtaggatttttctcaattaatcctaaaacactatcttgtcgttgtagtattttaggatgtcaatccaatccggtgtgatgcaaacagatgagatatgattagaaagctctaagtcaagccaagcagagagtcggttggttctaacagtcctagtatgcaataacagaaatgaaatgaaactaaaagcagaaatggcaatagtaggcaggtaaataacaaagcagaaatgataacaggcaatcaaatggataaacgattcttaaggatggggtaatcgaatagtatggtctccttaatctattcaagtggttgacaaaacttcatagaagctatccctagacaacaagttcaacaacagattaattcactcccgtgatagaaatcctcaagcataactagacactgaactaattctcattagcgatctctaactaagaaggcattatcgaatcaacatgttaaagccaataccctctctacagtcaatccgttggggtagagtcagatacctctggaattaattggatccaacgcctattaaacgccttctgagcgctggacgtctggactcatattccacattagtcagtgaaacaagcaataagcgcaactaatccagaagggattctagtattctaaactcaaccacctaaaacgaccaagtaaactacaactaatctatctcatcctcagaaatacagttcactactcagacataatcaaaaacaatagcaaaacaacgattgaaaacatgataacagaaataatgaaagacaaaatacaaagtcgcaggagaaacacttcagctatgaaagttgcaaaaaagacgagataataacgaatgccctcgggaaaaccctaagaggcagtttatataagcgagaaatgaaacaaataaggaaactagatatatagcgaatcttcacgtcatgaccctgcgaccgaatgtgtcattggcatctgatggactaaaatgagctttcctgtgatcgagtatgtcattgatcaaactgggctgcaggggctccgcttgcgatcaagtgagatgcagtgaagtcaagattgaatggtccagcgaccctctgatagagtgcgatcgagtgaatatcataaggtggttattgagtggttctgatggggtgattcctccggcttcgcgattgagtgaaactgagctgctagcttctccggggttgcgatagagtgatttgccctggcagggctccaaggctgcgatagagtacttttgctgaaggtgtcattaggcattctaactttctgttctgtttctcctctgtttgaaatccaaaagcatccaaagtacctgaaaacaaccaaatatgcaatgcacatgcaatcctaatgcaaaatcgtcctaagtatgcaaaacacactaaaacgactcttaatgagatgaaatgtggacgaaacaatgacaaagtggtgaagaatgaatgccgaaatcatgcaaattatagacatatcaactcccccaaatccaaagactcatacggactttggctacaccataaaagctttgagaagcatgaagaagctaggttaatgttttggagtcaagtatgactagatgtcatgtgtatgattgattataagaactataaccgcaactggttcctaaaagctaaagtagtgtttccttgttagaagatacaaagccaaagtctcaaacggacttcagctacaccatcaaaattttgagaagcaataagaagcttttttagttttttggagtcaaatatgactagttgtcatgtgtatgattgagtataagaactagaaccgcaaccgattcccactagctaaagtaatgtttccttgttagaagatacaaagccaaagactcatacggactccggctacaccatcaaaattttgagaagcaataacaagcttggttagtgctttggattcaaatattactaggtgtcatgtgtatgattgagtataagaactataaccgcaaccgattcccaaaagttaaagtaatatttccttgtttgaagatactaagccaacgactcatacggacttcctctacaccatcaaaggtttgagaagcaataagaagcttggtaagtttttcagagtcaaatatgactagaaccgcaaccaattcccaaaagctaaagtaatgtttctgtgttagaagatacaaagccaaagacttatacggacttcagctacactattaaagttttgagaagcaataagaagcttggttagtgttttggagtcaaatatgactagatgtcatgtgtatgattgagtataagaactagaactacaaccggttcccaaaatctaaagtagtgtttccttgttagaaaatacaaagccgaagactcatacgtacttcggctacaccatcaatgctttgagaagcaataagaagcttggttagtattttggagtcaaataagacaagatgttatgtgtttgattgagtataagaactagaaccgcaacatcttcccaaaagctaaagtaatatttcccttctagaagatacaaagccaaaaagtcataaggacttcggctacaccatcaaagctttaagaagcaccaagaagtttggttagtgttttggagtcaaataagactatatgtcatgtgtagtattgaatataagaactagaatcgcaaccggttcccaaaagccaaagtagtgttgccttgttagaagatagaaagccaaatactcatacggactttggcttcaccataaaagttttgagaaacaataagaagcttggttagtgttttccagtcaaatataactggatgtcatttatatgattgagtataagacctagaaccacaaccggttccgaaaagttaaagttgtgtttccttgttaggagatacaaagccaaagactcatacggactttggctacagcatataagctttgagaagcatgaagaagctaggttaatgttttggagtcaagtatgacaagatgtcatgtgtatgattgagtataagaactagaaccgcaacctgttcccaaaacgtaaagtagtgtttccttattagaagatagaaagacaaatactcatacggactttggcttcaccataaaagttttgagaaacaataagaagcttggttagtgttttcgagtcaaatatgactagatgtcttttatatgattgactataagacctagaaccacaaccggttcccaaaagttaaagttgtgtttccttattagaagattcaaagccaaagaatcatatggacttcagctacaccatcaaagctatgagaagcaataagaagctttgttagtgtttgggagtcaaatatgactagatgtcatgtggatgattgagtataagaactagaaccgcaattgcttcccaaaagctgacgtagtgattccttgttagaagataaaaagccaaagattcattcggacttcggctacaccatcaaagctttgagaagcaataagaagcttggttagtattttggagtcaaataagataagatgttatgtgtttgattgagtataagaactagaaccgcaacatcttcccaaaagctaaagtaatgtttcccttctagaagatacaaagccaaaacgtcatacggacttcggctacaccatcaaagctttaagaagcaacaagcagtttggttagtgttttggagtcaaataagactatatgtcatgtatagtattgagtataagaactagaaccgcaatcggttcccaaaaggtaaggtagtgtttccttgttagaagatagaaagccaaatactcatacggactttggcttcaccataaaagttttgagaaacaataagaagcttggttagtgttttagagtcaaatatgactagatgtcatttatatgattgagtataagacctagaaccacaaacggttcccaaaagttaaagttgtgtttccttgttaggagatacaaagccaaagactcatacggacttttgctacaccataaaagcttttagaagcatgaagaagctaggttaatgttttagagtcaagtatgacaagatgtcatgtgtatgtttgagtataagaactagaaccgcaactgcttcccaaaagctaaagtagtgtttccttgttagaagattcaaagccaaagaatcatatggacttcagctacaccatcaaagctatgagaagcaataagaagctttgttagtgttttggagtcaaatatgactagatgtcatgtggatgattgaatataagaactagaaccgcaactgcttcccaaaagctaaagtagtgtttccttgttagaagattcaaagccaaagaatcatatggaattctcattcggacttcggctacaccatcaatgctttgagaagcaataagaagcttggttagtattttggagtcaaataagacaagatgttatgtgtttgattgagtataagaactagaaccgcaacatcttcccaaaagctaaagtaatgtttcccttctagaagatacaaagccaaaaactcatacagacttcggctacaccatcaaagctttaagaagcaacaagagttttggttagtgttttggagtcaaataagactatatgtcatctgtagtattgaatataagaactagaatcgcaaccggttcccaaaacccaaagtagtgtttccttgttagaagatagaaagccaaatactcatacggactttggcttcaccataaaagttttgagaaacaataagaagcttggttagtgttttcgagtcaaatatgactggatgtcatttatatgattgagtataagacctagaaccacaaccggttcccaaaagttaaagttgtgtttccttgttaggagatacaaagccaaagactcgtacggactttggctacaccataaaagctttgagaagcatgaagaagctaggttaatgttttggagtcaagtatgacaagatgtcatgtgtatgattgactataagaactagaaccgcaaccggttccaaaaacttaaagtagggtttcctcgttagaagatacaaagccaaagacacatacagacatcggctacaccatcaatgctttgagaagcaataagaagtttggttagtgttttggagtcaaatatgactatatgtcatgtggatgactgagtataagaactagaaccgcaactgcttcccaaaagctaaagtagtgtttccttgttagaagattcaaagccaaagaatcatatggaattcagctacatcatcaaagctatgagaagcaataagaagctttgttagtgttttggagtcaaatatgactagatgtcatgtggatgattgagtataagaactagaaccgcaaccgcttcccaaaagctgaagtagtgtttccttgttagaagatacaaagccaaagactcattcggacttcggctacaccatcaaagctttgagaagcaataagaagcttggttagtattttggagtcaaataagacaagatgttatttgtttgattgagtataagaactagaaccacaacatcttcccaaaagctaaagtaatgtttcccttctagaagatacaaagccaaaaactcatacagacttcggctacaccatcaaagctttaagaagcaaccagagttttggttagtgttttggagtcaaataagactatatgtcatgtgtagtattgagtataagaactagaaccgcaaccggttcccaaaaggtaaagtagtgttcccttgttagaagatagaaagccaaatactcatacggactttggcttcaccataaaagttttgagaaacaataagaagcttggttagtgctttcgagtcaaatatgactagatgtcatttatatgattgagtataagacctagaaccccaaccggttcccaaaagttaaagttgtgtttccttgttaggagatacaaagccaaagactcgtacggactttggctacaccataaaagctttgagaagcatgtagaagctaggttaatgttttggagtcaagtatgacaagatgtcatgtgtatgattgagtataagaactagaaccgcaaccggttccaaaaaattaaagtagtgtttccttgttagaagatacaaaggcaaagacacatacagactttggctacaccatcaaaattttgagaagcaataagaagcttgattagtgttttggagtcaaatatgactagatgtcatgtgtatgattgagtataagaactagaaccgcaactggttcccaaaagctaaagtagtgtttccttgttagaagattcaaagccaaagaatcatacggactttggttacaacatcaaagctatgagaagcaataagaattttggtaagtgttttggagtcaaatatgactatccgttagtgtcgctctcacggaaaagtgactttgtcatccggtccgttgaacggttgcgcccagttacgatttgaatcgaccttcgtttgagaagccttgattgaggctgttgtatcttgacaaaaggttgaacctcccaaaatcgtgaagattttgctccaagtagcttcttcttcatcgtcatctgcctcggggtcgccctaacctctcttgggcccttcagggtttgccgcggggactgcctactcgagtttcgccacagcattcacctgctcaactctggctttctctacttctaaatattcgatggtcaaaccccatccaatttcacccactaggaacttggccgccaatttagctccaagactatgacacctggaagtgtgacgaccgtagctcttgtgcaactcgcagtattgcaatttagctcttgtgcaactcgcagtatttagtccaagtgtaggactctcttcctcgacctcggggcgtgtcggcttggtaattgtgtgctccggtgaagttttgcccctcatgatgcacgaaggtcctgccttgagcgccctttttctggctcggagcgctaggttgggacttatcaattcgaggtgtttgcttcgaaggctcgtgctttttcgataacaattccatttcttcctcatgggacataatctaaggctcagtgcagagcgtcttggatcgtttgctgtttggatagatttaattccttacggaattcagacttgtaccacagtgcctttttcaagggggagagggccgcgacgtcattgattccctcgactttgggtagggtggacctgaattttgtgaggaaatctctgagtggctcgtttggctgctgagatagcaaccaaaggtcggcgtctgaggtgcctagatcaatcaacactgagtattgcttaaggaaaaacgtcgagtgctcttggaaactgtaaaccgaattcccttcaagtctcgagaaccaatccaaggtcgaccccttcaggtgctcgacaaatagatgacaaaggccagcatctctttcctccggtctgaatttggcccgagctacaactattatgaaagatttgagatgcccctttaggtcagatgacccgttgaaatactcgatcttcatctttcatggctctgagattatcgcgttagagattttacgagtaaagggcgtgttctgtgattcttcccggatgtggtcgatgttcggagccgaggaaaccgtgttgtgcatctgtgaccgtacgagtttcatcttggtttctaccttggccagggagagtctgatggctttcatctcttgctccctagcgtactcttctgcccatcggatgttttcttccgattcctcatcgtcggaagcttcgatttgatcggctccagcagtttcagctcgatggttgtgattttgcggatcaaacgcccccacctggtttgttgggttctgttctcctaaacatgtcaattctgcttgggttccaacgagtgctggtgcgattagccggggtggtctcgtcgttttgccaggtgtagcgattacaagccttgttggattgaggtcagtcgttactcgacgagcctgaaattgttgcgcgccgatgagagtggtcctcagctgtccttgggaagtagccgcctggagctgctgcgccaaagatcggtgcacttttttcctggtcgtccaccttcttctagagttgtgccatcatgcttctcagttctgctaggactgtaggagcggcaacctcaggagcgttcgtctggactggatgattcgggtttccctccacgtcgacagtgttagcgaggacctggttgttggtcattgcttcttggttcgatggttttgtgttcttggagtaagagaaatctaaatcccccctccttctagcgccaaattgttagagtcgaaactcgcaaagaaacagtcttcgcgagaatctcaaagatcaacaatcgataagtaaccacggatggtgtttttgatattattaattggaaacgatgatttgatcatgcaagtgtttagaaatgtgattagaaaagtgtttagccttcaaagtcagagcctttttgatagtctgaagttgagagcattttttgtgtccccttttgcgaagtccttgaggtcccttttataggccaagtgaccgcctcctgcaatattctcggaagatttccatttatctttaagtcggctaaaaaggatctttgcaataaagagattttccttattcttcgggagcttcagaaaaactttcagatttgacaataccctcagagattctccaatatcacttccgggtttttaggaaatgatttttgggaccttcacagaatttgtacaagtcttttcctcaagtaagtatatggtctggggaacgctggattttggcttgggacgaatactgcttgataggacgttcaccgagccgatcctagacgatccccgaggcatgcttaagcttggctcgggcgtgtttcctggaataacactcgaaccgtttgagggattaaagaggtgttttcttgaggcccgaagtattgctttccccggctctgggtgtgttgcttggaatgacacctgagccggataaggactctctcgaatcatttctacgcctttgacggcgacgaacctagttacctaggcgcttatgactctgttcggctcggttatttgggggaaataggaaatctgaccccaacaattattcttctacttcgtaaccaacagctcttcgcccctcgtggtggtcagggatgttgttggagacgacattagcacatagattttccgctgaaattttgagattaggttttattcatagaaaaacgaaactctaagattaatcccagtcttgggcttaagcccataattagaaaccctaagcagctaaacatatgatattagaggacaataagcccataaattaaatcaaaagatatagtagttgaatttacagcttaatatggtataaatcacattctagatgaatttagctgctttggtttgaatataaataattagggattgaaataatgagtgtaaagacatgtaattttcattaacagggtaggttttgtattttagacgataattccatatggagtgtttataatctaattcatgcatgagcacaaagatattcttatatatgaacactctatgggtgacatatgagttaataaatcctagaaccaaccgctatgagacataaccagtgcgcaggagaagaacttatagttggagttgggaccaaaagattacaatttgacttgttattggctacgatttgattaggtttcatgtagagagtgaaccaacgtggatgagattcattggggaaacgtaagcagacataaagacaactctctatacgacctaagagtgagcgagtcttgtaaagctccggagaagcaatgagtgatcggaagttcttcaaaactaaggagagaatcgaatagtgcaatctcgagacatgggctaagcagcttactaacacatcatgaggaagggacaaactctttttctgcttcctaaccaatggctctttaccgttcgtggtgactggagacgccattagtagttagattcaacgctgatttgaaaattaggggttttacatagataagcgaaaccttccgggctcacactagccctagtcttgggtttaagcccttattagaaacttgatgctattaaaatcaaaaacaaaatctcctttcgtacttttggacttgcctcatcaaatataaagttgacatgtttgattgccaaaacaaaaacaaattggagaaaactctcgacttatgagtaataggtaaaatatatattatcatataaagcccaatggatccatttcttattgaggaagtaaaacatgatctctagaaaatatagttaagacttatgatagaaatattaaacaacttgatgaatacaacatagaatacacaaattttcggaatgaaataattttaaaaaagcaactaaacatattatacaaatgattttgcaaagatccattccataaagtaagcaatcaagagtagttggaaattcaatctaaaatgattttgcaaagatccattccataaagtaagcaatcaagagtagttggaaattcaatctagagttattggcatcccaccaaaacccaatcatatcgtttgtcttgtaattgtttagttggagaaccatactctatccatgaaattggaaatttccatttaaatcttcttttatgataagagttcttataattaaattcaaaatcgaaaagtccaaataacctatgaaaatattcataggccggaattaggaaaggaaacactttggtttctactatctcttttgagaacgttatcatattactcaaacctatgtttgatggtgtttaatgttatcaagatgttccaagggctgtccacattaaacgcgcggcttatctggatacagctcggtatctaccttaagttagaacacaaagatctatgggtatccaagggctgtccacattaaacgcgcggctcatctggatacagctcggtatctaccatgagttagaacacaaagatatatgggtatcagttttaagtgttctttttcttagagatatctaggtaaggtttgggttagaaattttgttaatgtgttaagcatatatataatgacacaaagatatattttcattgagcattagtcaaacttaaatcatatgcacacatatatataccgatcaaatgaaacctaatccgcttagttgaataattagcaagaaataacaaacaaatcacttaaatttgtattcaaaaccctaaaacccaagagaaaatgaacaaggtttcattcataagcttagaatagcgcaagactatatatatagacaatagtaacgaaacaaatacaacttaaattttataattttttaattctaaaatattattttgcagtggaccgtacatttaaatcaaacaaaataatagcgtatacatagatcatcctaaaaaaattaatcttttatttaattaacatataggctcgcgatgtaccgcaaattaatctctaacaaacataagggatacacttatatagaaaatgaattaatctaattatctaactaatagaatcatataagatatatacatatctctagaatatattcataatatcttcttggatcatatggatcttctagatccttctataagaacatggatctttttgtttctctttctcttgttctatgttattttggtttaattaatttaattggttatcttatatacatttttgcagccattttgtgaaataaatcctggagttggaacttatttacaatggctgtcaccggcttattcaatgcgaaaattaactaccaaataaaagcaaatcttattcaaaagaatatgctcttattccatggcctaattatttttgccaaaatggttaaaagatttaaaaattaaataatcattcgaaagaaaactttaaattgatttaaattataaatattttaataaaaatattattaaaaaaataaaaaaataatttcaccgaacatgattagatagtaggactagatggtatgacgtgtttataatattataatatataaactttataacaattaaagaaatatttgaaagaaaacttttaaattgatttgaattaaatattttttaaattaaagtattattaaaacaaaaatcacaaaataatgtctaattttactgaacagggttagtggtaggacgggtttggtcgacagtattacgagatggtatactacaagtgaaatccattagatatgtttaatttcactgtgcatgattagatggtatgacgggttttgatcgataataatacaaaacgatatactacggatgaaatcctagatataacaattaaaatctatatatacattatcttaaacactaaacaaagcaaacaatattaataaaacaaatatctacatatacattttatataacaaattttattaaaaacctagccccgcggtataccgcgggtcaaaatctagttagttattatagcaactgataaaaaaaatataaattagatgccgattatgtataattcagaaatgtcatcagatttgttacaacatgcatataacctttttaaaagccaaaatatttaggcacatagaaattgtattagttagattaacgcgtgttaaaataaattaaattttaatacatattaatttttgttttgctgtcttgatttattatttattgcaaattatgagaactgttacacaaatgattctaccacaaacaattcctttttatgatttactatcaaaatattatattaaatttgaatgtatagataaaaaatttggagaaattgtttctctcgactcttttattatttacatatattatcttataaatccaaatatatatatttataaatataagagaaaaacatgttctctagaaacaggaattaaaccaacataataaaacgacaacaaactggactcgatcagacaaacccggtatagatgcatatccgagaaatgaagttgtgaagattcgctccatcaattaagcaacatgtttgaaatttagtctagtatgacgaagatcccaccaaaatgcaatagtatcgcctgctttgtaatgttttctttttagaatatcattccatccatgaaatttaaaattatttccatcttgtcttatgattacatatgttgtaatttgagtatcaatatcatacactccaatcatctttggcttgtcttgaacttgtaacaactggacgagagtacttatctccatgaaaggaaataaattggtttctagtaacgcttttggcatcattatcgtagtactcctatcgacgtcaaatggtgacaacgttatcatgatgttatatgggttgtttgagtcatactgcttatctggaaaattcgccatgagttagaacagaaagatatatgaaaaatcgggtttcaatgttccttactccgtaaaggcttatgcaaggtttgtataaaaatatttgtttgtgttaagggtatatatagtgacaataagttgtacttatgtacgtggttaattgtaattaagagcttataccaatagagagatactatgttttcaagttagattaaaattaattaattgaatatgttttgtcttacccaaataacactaattttgtttgatatatagtttcataatattatgacatatatagttttgtagttattgaattctaacacgtgttaaagtgaaataaattttgacaggctgacttaacatcaaaaagttttgaagtaaatgtcatttaagtatttgacatttttttggctcatgtagttgtgagcttgcaaatttaactctataagattctgtaagattttttttttacttaagacaataaatagtttttctttttgaccaaactattgtggcacataaactttaattacattcattagaaatatgggtaatatgttaatcagtgaattatatgttagaatatatatacacaatattttcatgagtataatagattcattattaattgaacatgttttctctttcaacaaaagtaatagttaagttttaggggatattattggtttatgatttcaaaggagttttattgacttaaaatgtcatgtaaaatatgttgttattcaatcaagataatataaaactatgttaatgttttgtgttattcatttaagatttgtaaaaagtaatctaaaatcttcataaatttggggttattggattcatattcttataaagtcagtaagagttttgtggtattcaattaaaacaaaagaatctcttattgttaatgatttaaattattatgttattggttcatgactttctatatttttgtttacaaaataaagtcataaaaagtaatgaaaaatattatcaaaatagagagattgtttaagaaactttacaagattattgtgaagcctaatctataatttccgattagaacttgcgacttagtttagggatttgaaagaaaatagaaaaaacgcaaacaaagaacaccgagattttacgagttcaggttccggtgtggaaccctacgtctcgccggagattgactccggaatccactagatcatagctcaaactcgagctcatacaagtgaccgttacaatcgctcaccggattacagtcactctcaagctttctctcactcaccaacacaaaaccagttactctctctacctctaactctaagctcacgtctctcgtcgacttgcgtagtctcgttgtcacgcttctcttatctgtttcattctgttacatactcaaagaagagtagagaagaagaagatacagagccaatgataaaagacccttttacccttctagttgtgacttattactaatctcacgtgtgtgcttctcacgtgagccaatgaaggaagcttgggtcaaaccctctgattgcttcagatacttatcacactttagcatatatcttgagatcggatgacactaaaccttcaaatctccaccttgtcatcgatcttcttcacgctccttatctagcttcttggattccatctccggtacttgagcttcaccgctcatcttgaacttcaccgttcaacttcaatgcttccttgaaaaattgtttcctcaatgcatcttaaaatcaacatgtcttgattctacttgaagacttcctcgcagctgctccttagaaccctttaaacttgctctaaccttgacaactccaatcttcacacttcaacaaccattagtgaacatatcttcgatggaaaaaaaatagctgtgatgtgaatcacaccgacgttcccgaaccatcgacgttctagtatcacttcttgagttgtgaaccaactttaacacagacttgtgtcaacaaaaaactcatgtttgcttcacttgtttccttcacagcctggatccttttttaacctctgcagatcgattcctcgctagccctttgattcatttcatgtgcactgaactttgaatcaaattctcccttgaatcattatgcaaaaatatcttggatcgcttgtgcttttctatcctgaaacagtcaatgattcatcctgcaaaacaatctaagccaataacccgttagtagtaaaatgtatttaactagagattgtacttacagtgatttgtttgaactttgagcatcactttgcaccgcctatgttaccaacaaaacatgcctcctaactttcacagagaaaggaaaacttccgatacaactctttttgctcaatctggttcgaaacccttctgaatcagcaaaccctttcaatccaacagatttgaacccctgttagcttctttaaacttgtctcatatcaacactcctgtgacatgcctgagacttctcctttacagcccttgaacttcactctagaacttctcgaagtcgcttccttgctgcaaaaaaaacactctgcaaaacgtcctcacgtttgcaatcttcacctaacttggcacttgcatcttaaaaccatcagagattaatctgaatcctttctttatcctcataagcttcctttacatgtgcctatttgttacttcttatgaagcaaaaaaggtgaacagaacttttccttgttctacttcttcattctcatcctatcttggatgaattcttctcagttgctataccagctcttatgatgaatcttttaaaccatgatttatgcattgcaattcacgtacttgaggtgaatgaaccgcagacaaattctttgcaagaccttgcacttgtctcttaccgtctcctaagagaatcacttcaataaacttttatcttgagcttgtacttcagctttgctgatcttcttaatcatgcaactgatataccaatgtctgaactaccatcaagcatcctttaaacctgaaaaactttccttttaactcctgttgcaaccttcttatgcttgaacgtttctgacatctcttacccgttctcgaaactctgtcttcttcacacacttgaccaatccgaattatatccaaacagcaacttatttcttctcatagctaacacctgatgcgttgaaaacccagtatactcagaccttgtctttgtacttaagataaccgagaaactcctcaactctaaagctccacctgaaatcacaaaccatcttttacgaacgtgtattacttccctgtaatactgatgactccacctgaaactttaaaccatcgatgttgcttgtatctctcgacattaattctgacttgccgagcgaactgcctctttgtcactgtctctataattctcaatcataaaaccttgtgcgcttgactgtatgaaccttatcacttgatatatccataattctttccactttgtagctacaccaacagtctctttactctttagcagtttgcttctagagaagctctcaatctgattttgtgatattatattgaatactttagtcttagagaccaactgatcaaccactaccttgttatagcattagaacacttgactcttcacacccttatactgaatttcttccaccataacagatgtctcctggaaccatctcacaaagcaccaccctttcttatttgcagaaattctcacactaacttgaatgtaccatttctgaaaactccaaagaaaacacccgaatgatgctagagatttataagcaggacctttattcttgagtcttcatgtctagatgtttctataaccagctgatccatttttattcttgactctcatacttagccataagaaccagaaaccaacttaaaatttccttggtttcattcttactggtttataccagtcacaccttgatttccttttacactagatgtttcttcatctgtagactgtagttgagaattgtttggtgcttcttgtgtccttgttactttctctgtttaaacagagaacactaatacacaaactcttgcagccttgtttcatttttccttaaaacactactgccaccaaacaaacacaaaacgatgctgcagctttaatccattttcacttggaatgtcctagctgccactaactcaatgatgaccagaatttaaccctttgattaccatatccttttagctcttcttatctcttaagaatctgataattacctctgagactgaatctttgaagaacccttactcaaaactcttgtaataccttgaatttttctgaattatcaacccactttgactaagcagaattcttgattattcttgaacgatcctgcaaattctgtctttcaataccgagccttaactgatgtccaaacaaccattaacccaataccaatcaaacaaccaaggcgtccccaagttcctagacttttatgagcttccaatagctgttctttacttatcttgaacacaagtttgcatcaaaaaacttccacacttccttaaccagaaaccacactaaccaagtatcgaatcttagctaaaaacttgtgcagtgaacatacaaacttgtgctttaccaaatcttgactcctttatttgcagacatgtagataccagaacatcacaattaaccttgtgacttgcagcggatgcaaacttagtttcaccaagctttgagtcttcatgatggtgacttgattctggtttcaagacttcaaatccagtacttgaactcacacacttcttaaaccagaaatcaaaacttcttgctggtgaatattcctccacctaagccatcactaaacattcttcttcttacatctccaaaactcgtagtatcattctttctttccatctggaccaattctcctttgcaattgcactcactagcgagtctttcttgatcttctcgcaatgatgcagacacaaaacaattagaggagataacttacaacttcacaatcttagaaactcgaagtagtcttcaatacgatgaaacgtatcaccgtaaaactttcatcctccaaaactcaaataacattgatccagactacgaagatcttaaactttcgtgatctcaacatcatctcttgtgaatttcttggactagaaatcacagtgatgtcaaacttcagagtctagaagagagagagagtaacttatcgactaaactgatttcataaacttgaaaccatttgatccggttggatctttctccgtggaggttctttcctctagctacgacgtcttcttccgagaacaaccgcagtccaattcttccttcgctcttgacatcacaacatcttccgtttttcttatctttagtcacgatatcaacgaaacttcaaatcctccgtttctttcaattcgcaatgcctctgctttccatgaaatcgtagaacataggctctgctaccaatttgtgaagcctaatctataatttccgattagaacttgcgacttagtttagggatttgaaagaaaatagaaaaaacgcaaacaaagaacaccgagattttacgagtttaggttccggtgtggaaccctacgtctcgccggagattgactccggaatccactagatcatagctcaaactcgagctcatacaagtgaccgttacaatcgctcaccggattacagtcactctcaagctttctctcactcaccaacacaaaaccagttactctctctacctctaactctaagctcacgtctctcgtcgacttgcgtagtctcgttgtcacgcttctcttatctgtttcattctgttacatactcaaagaagagtagagaagaagaagatacagagccaatgataaaagacccttttacccttctagttgtgacttattactaatctcacgtgtgtgcttctcacgtgagccaatgaaggaagcttgggtcaaaccctctgattgcttcagatacttatcacactttagcatatatcttgagatcggatgacactaaaccttcaattatgaaaaaactctacaagaatagtttaaattctttcatttatttattttctaggatttgattgaagtcatcaatattccttgtaaactaagaaccaataacacccccttaatatttcataatattttgacaaatatagatttataaataacttgattgaaacatatgttatagtacatgacatattttgatttcacacaaaataaacaattaaagtaaatctgaaactacgcccagaatatgttggttatgtatttggacgtatattaattacttgattctttccaaaatatcttccttcttaagaattttgttctctatttataattttgttggtgcagatatgtaattatataagataccattatatattttacgaattttattagatttgttactcgtctagtatgttatataatttttaattttagcaaaaatttatctggcacctaaattttgtatactgttagattaagacaggtaaacaaataaagtaattctttttatatgctgaacaccataagaaaataaaataaaatcaaaaaattatcaattacttaatatttcatcttaaatatctcacatcgaaaatagcaatggtttttttaatcaaaatttgtcctaatggattaaacatcataaacacaattcgtttggttcctcaagcacaccatccctccattttgcggagttcaagtcctcttcaaatgcagtttttccacaaagttatctttgcagttgtttttttctaccatatcctcaatttttctgttgctttatttgcatctcccaatgaaagagtggctctagtatacaatttgttgatgtggcgattgtctagtccttaagtgtatttgggttggaatcctgttaaggtaaaagagaaatatcaagtgagtatagtttcaagatttatttgatgtcttgtaatcacatttttaccatgtaataatgagaaatgtttattttcgcaatataagagaagaaacagagaacaaaggcatatatttatgaaactacacatttagttctagagtagcatatttatgcttcatgatatataaccctattcttactaattttaactatgttttagatataagtttttgagtctttttgttatttctagagtcttttcatgtattttatggagagggacaacaatggagatgagaagacattttggagtaaaagctgaagaaaagaagctttctagaggaacaactatgagctgaagcctcgctaccgatcaacgatcatacccagacctttttagaggaacaactatgaactgaagcctggctactttgcactggtaggcaagcaccctttccatggcttatctcacgagcagccaatggaccacatcgagcattttgatgacttcgtactaaacattaaggctaatggagtctctgaggactacttactgtgcaagcttttcccttactcacttgctagggaagatgtttcttggttgaagcaattaaaggctagttcactcactatttctatcaagaagcatcaagaaagccttcctgaacaacttctatgatgatgctaagtctgagaaggtgcggaacaaaatgtctaccttcacacaaagtcaaagaagcatgggttcgcttcaaggaatatcaacgggactgcccgcatcatggcttcagcaaggtacaacttctaggtaccttctttaaaggagttgattgaagatactatatggctctagattcagcgcgcaatggtaacttcaataccaggtatccgacagatgctacatcattgattgagaaccttgcgtgcaagaagagtacaaagaacgctgactttgagaggaaaaagattgcaggagctgtttcaaggaatcagatggttgaggtacatgctaagctggattcagttcataacttgcttatagggaagaagcatgtacactttgcagcttaagaagagactatcgagcctgagctagattcagaagaaggagtcttctacattgatggtcaaggttacaggaagttaggacaaccacatggcaactttagtggcaacatgtttacagggaaccagagttcttcaggcttcactccaaaaccttccttctagaagacctttccttagaagaacttctagagtatttatggtaattcatcttaccaaaactcccctccactctcagccgagaataagatggaatcaatgcttgaacagattcttgagggtcagtccaacttagttatggactttgatggcaagtttgatgctatctacacatatcttaatgggaagatccaaaatctgagctttctcatgaataagctagttgttcaaatacctcaaactgcataatccattaagagacaagaagggtttcttcctggcacccctgatgctaatcctaggaagagctgcaatgctatcatggtcagcattaaagaggaaagctgtagagagtgggctgctatagacgagttaggacacgctgctgcagagttggtgtcgatcgacacacatcagtgtcgatcaacacaaggcaacccgatctgggacgaatcagatgacgagacagtgtcaaacaggaatagagaggatcgttcgtcacgcgacggtgtcgaccgacactcatctagtgtcgatcgacactaaacagaacaaacacaacatgaggagctcgcaccgatctactttccagatattttatcaactccaaggcgtctttctaagcttgacaataagaagtgcattgctgcaatggaaaagatattgacaaccaatccttgttttgcttcggagacttcacatatctattttttgaacagaaacaaatggtttgtcaaaaagggaatcaattatggagaaaaaccaataatctccaagatattgtgccaactgaaatcatctgaggttacaaaggacaagccaaggagagttgacattgctgggtacatccgtactatcactccgagtcagagatcccagaagctccacgatcttggtagctttgttcttgactactcgatatctactagcagattcagccactccttgtgcgatctgggatcaagcattaacctcatgcccaagtttgttgttgagagactaggcatgaccatctacaagcatacaaggattactctcctcttttcagatcgttccaaacaaatccatgaaggtatcctcgaggatgtccctgtgaaagttggtaactgcctcatccttgttgtttcgtggtcttggcatatgataaagaacttaaggatcctctcatccttggtagagctttcctagctatagctggtgctaggattgaggtgaagaagggtaggatatctctccacatatgtgataaggagatggagttgggtatggatggttcagaattcacatcgcctatcagtagcattgccaccaacaagaacaagtcttctctggctgctcagacttcacttttagagccaacaacagagacccctacagcttagcccgcatatgagatttgcagagaaccagtgtcaatcgacaccacaccccttgtcgattgacaccatcgcgatagatgcttctgcacctcctttagagcccacacctatttcagttccctgtgataggtactacactatctcttctcttactgttcctttgattatttctttatattgttcgaagtgtgcttcaccggtaaacgagcatcgagtttcccgaaagctaatttttctgttgatcttgcaggaaacggagagagtatcgaatcgacacaaacaactgtgtcgatcgacaccaactgctgtacaaggccgatctgtttacataccgccttggaaggcgcgaatgcagcacaagtcctccacccctccatccaagtcctgaactcctccaagtgaacctattgactctaattaagcgcttagtgagagggaaccgagtggtatgattttttttctttttatttcttttatttttggtttatgttttcttctctcttcggatttgaatgccactggggacaatgatatttaagtctgggggaggcgcttattaactatgcttttatttttgattcttattattttttgtgtttagagttatgagtcattttattttgttttctaaaaaaacatttttgtttagtctaattagaaatcatgatctatatttctttagattattttctggttgatgaatgcagaagggtcaactcaatccgactattggaaaatccagatagcaaaccgacaaagttgaggatatcctggtttccaacacaatccattacgggtggatctaatcacactgctcttccatttacctcatcataacggttagtattcatagaacttgacgttttgttcatacctgttattaagacctatgtgaaaaaggaaagtattcctctccccttataaaaaaaaaaaaaaaaaaatgatatgattttcggtagtgtataacggtaggaatgttttccatgaaccaattattatacattattaggaatgatcaattacaacggttggaaatatggaaatatgtcaacggtgtcaataagtctgggacgagaaacaataccagaaaaatataaagaacggtcgatttatcatggtatattacaggaatgagtctagaaggttcttgaatattagcttgcttgatgagacccagcgatgaaagcaaggtggatatagttgtggaacttaggtatggaatctagaatgttgtgtaaacttgtagagaagtacatgttggttaggatttgattagaattactaggcatatgaatttggttagaatgatcatggcaatagactatgttgggagttcctttgtttttagaacctcttccacgggttcggcttttgtgttttgtttgagggcaagcaaaagctaagtctggggagttgagataaccctatttttactgttttaactatgttttagatataggtttttgagtctttttgttatttctagagtcttttcaggtattctattgagagggactacaatggagatgagaagacattttggagcgaaagatgaagaaaagaagcttaaggacgaattcactttcaaatccagtcgagagtatcgatcaacacactcttggtgtcgatcaacaccagttgcggcccagagaaatccatgatgcttttaagtttgaagaattgaaaatttgacccagaagacttccttattttcgttattagtccctgcacatttttaaggtcatatatatagttttaaaagtcattgtttagacatatcaagctttttatcaagctttctatcaagctttttatcaagtttcctagcaaccaagctattcatcccatgttttcagagtttcatcagattttcaataactgtgaagaaatcttttctaactcttttctctactgatttgtttatgctttcttactcatatatgttgtgtatttcatccatcatgtctgagcagtatgcttgttagggatagggtttctcactagggattcatatgatttagtagatcgccccctttgcttggttatttgtaggattcttcatctttagttgttcttaatgctagttctagagtaattaactagaacttgattccagataatagatatacccaccataggtatctgttaccagaactactatttgaagaggctggtttataggtgtgtaataagaatcggcctatctactaaggtgaacttatcaaactcggttagcatgcatgtttaggtataggatttcacggcacatcaccggaaatcttagctctaggcatagtgagtttcatggaacatcaccggttattctgatattagagtttgagtttaagaacagttggataacaacctaacgatatctagacctactaatcattggttcctgaaaatactctaaacttcacaaccaacaaacctgctttttgcttactttactttctttttattttttcttacactcttctagcttaatcttgatacttagctcattgtgtgaacaaaagaactttgtggaatccgacctttaaatattgtactcaatctgttatttgagagagaggttttaaggcaatttgaactatatcacttcacatgaatcagaaacgaaagtgcttaaacaaaacataataatcactttgtggctttttaaacaaattaatatttgttacagagtcttagattgattgatataacgttaggggatcaccaatacggaagtagagtcatattgtaggcgcaagaaccatgagaattgtaaagaaatcgatgtttgtaaaaattagttttgtcatgcttaacggtctaaatcaaatgacacataccatgactatagcgattctgaaccgttttagaaatagcctgggtagaatcgtacaggtgacaagtacttcgcacgggccgatccaggtttaagcaccaaactcgtccctccaacctgcccacgcatagtaccgtccctccaaatcccaatatccggcttgccaaccttttaccgggaaagggagttatgcggttcagacaaaaccttatatcatcaaccatccccatttgtttttagaaaacctttttatacatagtataatatgataaaaatcgcacaaacaatcatataaggtttccggggatcccgtttcacaatacataatacacaatagtagtctttacatttatacccaacaatctacaccaagaacctattgtcccaacgaccctctatggtttttccccctaaggtcacctgcaacagaaatggtggaatcatgaatataagtactcaatgagttcggcgcctaatctcagaagctaaacaacccaacccataacaataaacgttagttaagcaacaagcaacaagcaatcaatatgcaataataatgcaatataatggatgcacgggtaaatgataacaatgcaatcatatggccatgtgaacgatccttcccatcaaaccaagtgaacaatccgctattagccaccaagtctacaagcgatgtaccacatgggactaccacaacatgtatcctcgttgcatcgtcatgcaacactcggccccttgggagcgacctagtctcgctgagtcgaacaaaacagggaagcgcactcgaacaccacaaactctatatgcatttaactaagctacgacaaagtgtacttgaagcatcaagcatacatgacgtaaatgataattcttattaattctatgatcaatcaacaacaacatcaacaagcacataatcatcaaagcaagcacataaggtaactcatgtgccaccacacatgcttcggaactcactatgattaagcggatcggatgagagtgatcacttagcggaatgacaacgtcgatcgggaacttctggttgatcgcgaagacttcatctaccttcggaaactgatcgtcggatggttcatggaaactgctacaccgtttggaattcagtcgtccacctctaccgtcggcttcaggagcggtcgtcacttcacgaagattttgaatctatctctctctctctcacgatttctgtttagctccaaagcctttgttctacttatagaggaggagattcgacccatgatggacaaatgtcgtgtcttaggtgacgcaaaacccacaaggacactcttcctctgattggcttggagtttgcgtcgtccaaccctatgggacacgccaccttgtcattgggtcatagtttgtgtcgcccaactcatggcaacactcgttctccatgattgactcgatgtttgtgcggcgaagctcatcattacctcgttttgtccaaaagaggtaacttgcccaacgattcgctcagaactgaaatattgccttgatttcgcccaaggaagataacttataccatgggcaatatctttcttttgattggggcagagatataatcattgtgtcgatcctgtaaataaggtggactttctctctccgaccaatgattacttttcttacgctttttcctcgattttcggaatttatgcttcaaatatttctctaaattcgaccgttccaagaatcatctaggccacaagttaggccgtcctcaaccatggaacgctcacatgggagggtcacagcattccccagttccatgaccaaaactgacttagtcaagtaagaggattttacttagcattccaattataagtcttttcccaagaccttacaaccccttggcatataactccgactcaaaatttcttaccacaaccgcccctatagtcaatgaccgggtcactacattcaccctctcattataattcgtcccgaattcccaatgagataaattgtcgacgttcttaacttggttagaactttcactttttctgtggggatccagcaagccaatcttgaaggtcttctccttctcgattgaacttcgcgtgagcatgacaaggcaagtccgcgatcttttctctcgatccggttcctttcattccaccatgccatcttataactggtcgtctaattctcaaagattctgttacttgagacttaaactctggtacaggtgctgaacatcctccaacaatccaagttgtgcaagtgtggtcaagcatggataactcgtgctacaaaactctaagtttgaagagcctgatatattcctcagcaggctatacatcaggtttgtgcagaagtttggtggctcagtgagtatgctcaggcatgtactcgtcttcctgatcctcatctataagctcatacctctctgtcattgctctcttccctcgagctatctcagcttttcttctgaagctatcatattctctgttctctctctagcctcgaagatgacgactctatctcatccatgttgtagtctggatcaactgaagaactaccactgtaattactcatgattctcctgtagaagatttagaactcaaaactcaaatgtcaatatattagtctcaaagataacaatgaaaccaaaattgttatcaacaggcaatgaaatggaccgaattggacgagtacaatcttgtactcgagtaaactaagctgttcccgagttccttttacacgaattggatcgagtaatgtagagaccgcggttgaataacttttctgaagtcgagtgggtctgccgatttgctagtaccagcggtggagtggttcctcagtgaaccggaattgaagcctggaatcttgaaacgtgaagcttggtcgagtggtcggctccaggaggtcgagtgaaacgttgaggtcgagttcagccggtaaagtccagaggtcgagtaatccttcggtgagccggaattggtatggtcgaaactacaagtcgacggtctagtcttctctttgtaattgagtagtccctaagacttcgatggtgaacgaggtagggactcgactgcggcggcgcagagggatccgagtagattgagaacagagtaacggtgaacagcaaggtgagaaggtcgagtaaagaagcaaatgaactcggtgacggcggcgaagcggtcgagtgcctttccagtggtcgagtaatctgatggggtcaagtgcgatacagtgaatcgtggtgaggtgcgttgaggaagaaaggttgaattaggtcgagtggttgaaaaatgaagataggtaggtcgagtgattttcgaaagatgtggtggaagttgagtttgacattctctctccatcttatttttagtgcgtggttcacactctgttgactgagaaaaactgcagaaaatctactgtaaattgcaggaaatcctttaaagtctctgtagctcttgttggtcgagtacaaagatgattaaaatttttttgggttttaaacatcacatatacttgactgatgtactcgaattcaggggctcccgatgcaacagaaaactttcaaaattttgcactccaccaggcaatacactcgatctccaggtcttctgtagagtaacagttttgaatttttactctatctccacgttgttcctttgttcttgagaaccacaaacacaactaagacaaatcaaaaataacaagaaaagaaaaaattatttacagagatagtcatgggacttcctcccaagtgagcttgtttaaagtcattggcttgactcctttactcctttaatcatcaagaagctcctagagatgaaccgatgtcaccatttactgtgaaatctccactcttaccagctagagtgactgctccataaggacgaacctcagtgatacagaaggggccagaccatctggatttaagttttcctagaaagagtttcaagcgagagtttaatagcagcacctgatcaccaacttggaaatccttggtgatgatctttttgtcatggaaaagcttagttctctccttgtagattttagagctctcataagtttctaaacggatctcatcgaggtcactaagttggatcaatcgcttctcctcagcagtttttatgtcaaagtttagaagttttaccgcccacattgctttgtactcgagctcaacaggtaggtgacatgattttccatagagaagattgaaaggagttgtaccaatgggggtcttgaaagctgtcagttaagcccataatgcgtcatcgagctttgcagaccagtcattccttgtaatcccaacagtcttttccagaattgtttttatctccctgttggagatctcaacctgcccgctcgtctgtggatgatagggagtggaaaccttgtgctttactccatgattcctcaggaggttctaaaaaactttgttgatgaaatgcttcccaccatcactgattactaccttgggaactccaaatctctggaagattatggtcttgaacagcttcagcacaacttttgcatcgttggtaggactagcaatagcttcgacccactttgatatgtagtctacggtaaccagtatatacttgttaccgtatgaagatgggaatggacccatgaaatcaatcccccatacatcaaagatctcaacttccaagattggattctgaggcatctcatttcttcttctgatgttgccttttctctggcatgaatcacactttggaacaaactcctgagcgtccttaaatattgttggccaccaaaagcctgcttgaagaatctttgacattgtcttgaacgtcgcgaagtgactagcatatgctgagccatggcaatgcagcaggataccttctacttcatcttctgagacgcatctcctatagatcttatctttacagagagtgtaaagataatgctcatcccagtagtaatggtggatgtctctgaaaaacttcttcctttcataactggtcaggttgggaggctctactccgcatgccaagtaattgacgtgatcaacataccatggagatcctccttaaacagcattcaagtggtgaaactctttcccactgtagctcccattgaatcgtctattggaatgggttcttcaattctcatccttgacagatggtaagctgcaccattttcaatacctttcttatctactatctccatgtcaaactcttgcaatagaagtatccatctgaacagtcttggtttagtattcttcttggcatacagatgcctcaaggcggcatggtctgtatagatagtgacctttgatccaaccaaatagcttctgaacttctcaaatgcgaaaacaacagctagaagctccttctcagttgttgcatatcttccttgagcttcatccaacgttcggctggcgtaatatatgacatgaagcttcttgtctattttctagcctaaaatagctcctactgcgtaatctgatgcatcacacatgatctcaaattgatagtcccaattaggcgctcgaacaacaggagcagataccaaaccatccttgatggtgtgaaaggatttgaggcagtcctcatcgaattcaaattcggtttccttgcacaatagtctggttaacggcctggctatcttggagaagtctttaataaatcttctgtagaacccagcatgaccaaggaaacttcttctgtccttcaccatttctggtggctgcaactgcatcatcacttcaattttccctttgtcaacctctatacccttttctgatatcttgtgacccaacactatgccttccttcaccatgaaatgacacttttcccaattgagaacaagattcgtctcctcacacctgctcaataacctgccaagactcaacaaacatgaggaaaaagaggggccatagaccaaaaaatcgtccttgaagacctccaccatctcctcgagttaatttgaaaatatagaggtcatacacctctgaaatgttgcaggagcattgcataaaccgaatgacattcttttataagcaaaagttccataaggacatgtgaaagtagttttctcttgatcattagggtgaattggtatttgaaagaaaccactatatccatcaagaaagcaatagtatgggtgattagctaagcgttcaagcatttgatcaatgaatggtaaaggaaaatgatctttcctagatgcaacatttagcttcctatagtcaatgcacattctatgaccagttacagttctagtagggatcagttcatccttttcatttttgacaacagtcattccaccctttttagggacgcaatgcactggagaaacccaagtactatcagagatagggtagatgacaccaacatcaagcagtttcaaaatttcttttttcactacttctttcaactaatccaagtccagcacgacccgctccctggagctacacaaaggagagcatggatgaccttgtctccacctacttcacctaaggtaacaccaccaccaccattgtacataccatagcatttttatttttctttgtgtgtttcgtgttttggtcttgaattctttctcagatttttattacacaagggactatgtaatttaagttagggagagggttgaagacatgtttaacattgtgttcacttttcttatttcatattttgcatcatctaaggtagagaaaaaaccacaaaaattcgaaaattttcaggaaatgatttcacaaaaacataatgtcatgtagattgcatttcatcttaggattgtatatagagtgtttgcttttgggattgctcatttgcataggggataatgatgacttcaaaccgttaagcatgttttgattcaatgaagtaagttcaatgcccaggttgttagttctctgttgcataaccgattgtttctctgaagtaagaccgcaccctgctttgaatttacaacttgactatactgctttgattcgaaactcgcttatcttatgccattccctatctattagaagctgaactgaatttgcaattatcatgtctatgcattgtttgtgaactcatggctaacatatacatatttggattatcttatttacttcaccaccccctgttaatccaagtagctgactctcatttttagagcagtttcccataccctgagcctagccttatttcaagccaaagataatttgtgtgtgattgtgaggtctttttcgattgagcttggtataacgtgttaggtatgagccgacaagagcagtcattcatgtagacctagcccacgctttttgggttagctaggactaggtggagacttgtatttgggattaggattgtgtatggattgaatgggaaagggaataggaatgaaaagaaaagaaaaaaaaaagagagtaagaagttaggcattgtgattcaaagaaaagggtaaaacgccctctatgctataagtttagaagaaaagccttaagtttaccaaagtttaaaaccaaacccgctagactcttgaatcattttaaagaagcacccttgagaacttgaaccaaaagagagaaagaatgagaataagggtagagttaggacatctaagggagtgggatcatcttctgagctttcataatagatgggagtctgttcttgtatgtgtccgttggcttttacctttagcattctgctgaagctcaatcttttctctgagagtcccttgttattcgaccaaatcattagagggaccatttttgtctcttaccctaagcctgaaaccaagtaagttcataaccattgcattgattgatccactgttcgtgcttaatgaatgttaaagggaattggttgatgtgaatgcttgaatagattaaggcaggttgttaggttgcattgtgacgagtatggctaaagttgttaagtaagggtctatcatcttgcaacctagaattagctacctggacagtgagcttacccattctatatgcatgctttggtttttgaatccccaccttcaaacatctccttcaacttaagattttttgtttgcttgagggcaagcaagatataagtttgggggatttgataacactttattttactcattttaggtgtgtatttatcatcatttagctttttgatcactcattgtatcatatcattttgcatcacatttagcttattttgcacccttaggcatttaggatcatcttgcatacatattgcatgtttggtgtgttttcaggtgcagaaggagcatagaaggtgataacactgtattttactcattttaggtgtatgattatcatcatttagctgtgcatttgctcattgtatcatatcattttgcaccattttagcttattttgcattcttaggcatttaggatcatcttgcatatgcattgcatgttttggtgtgttttcaggtgcagaaggagctaaaaggactctactcgatccatttactcgatccaagcagctacagaagaggcatcaattcactcgacctctttactcgatccaggcagctacagaggagactgcaattaactcgacccctttagtcgctcaaggcagcctcagtggaagcagcagatttatctactcgcccctcctacttgatcctctactcgacccatttactcgaccaagggtgaccaactctacaagacttgttgatctatcaaagcgtctttggatcctcctcattccccactcaaccagacatctaagcatatatataggagaggaaggaacatctactcgaccaattgattactcggagcatagacacaaaggcgcagactttgcagcaccctctttactcgatccccaagatcgagcatcctcccaaaccgcctcaagtctcttgtcttctagtgaatctagggtttcaacattttactataaattgatcactttggggtttgtccaaagaatctatcttttatcctttagtttttctttgtgtttatgaatcttcaaaacttaattactcttaatctatttcgtttttgcatttagttgtttaagtaaatttgtttaacttgtttagatctacattttggtatgattttaataatttctgggtttgtgttcttgagaatgttgcttgagtagtgattaaggttcttgaggatggattagattagggtaatctctaggtaagttaggtggttaagattaggttagaacccttctgggttcgcttggcccatatgcggttttcgttggctaatgtggagattcgatcatagacgtttagcgtccaaaagacgttcaaatggatgtcaaatctacgaattccagagatttgtagactcgaccaagacattggcttgtctgcttattggctttggtagattgtttcttaaaccctgctctgctatgtttcatcaacgacagttgagattaggaagtggtagagttatgggggtctctgtcacgacagtggactgacccgatttttgaatctatcgtcaagggtatctacctttcacctattagccatctaatgaaccctagagttgcccttatcaatgaatccatccttagaacttctattagatttatttgtattccttgttgattgcacttttatttacctgttatttgtatccccttttgattgcattttagttactttaattcgtcacctgttggttctactcgacccaatgatcgagtagggctcttaagctctcatttttacttgtttgaatcctgacctaggatagttactagaaacccaccatcattataatctggcttgacttagttgcttatatccacatcttgattgcgaataagaatatgagaggaagaagcaactactcgaccaattgatcactcggagcatggacagaaaggcgtagactttgccgcacactctttactcgatccccaagatcgagcactcgcccaaaccgttcaagtctcttgtcttctagtgaatctaggttttcaacattttagtatacatagatcactttgggatgtgtccaaaggatctagcttttatctctttgtttttctttgtgttcttgaatattcaaaacttaattactcttaatctattttgtttttgcatttagttctttgagtaaagttgtttagcttgttggtctctgtcacgagagtggattgacccggtttttgaatctatcgtctaaggtatctgcctttcgcctgttagccacctaatgaaccctagagttgcccttatcaatgaattcatccttaggacttctaatcttcttagatttatttgtattcacccctgattgcacttttatttacatgttctgttgattgcattttggtatgatttcagtaatttctgggtttgtgttcttagttatgatgcttgagtagagattagggttcttgaggatggataagattagggtaatgtctaggttagtcaggtggttaagattaggttagatcccttctagattcgttggcccctatgcggttttcgctggctaatgtgaaaattcgaccataggtatccagcgtccaaaagacgttcaaatggatgcctgatctacgaattccacagatttgtagactctagaccaagagattggctagactgcttattggctttggtaaattgttgcttaaaccctgttctgctatgtttcatcaacgagagttgagattaggaagtggtagagttatgggggtctctgtcacgagagtggattgacccggtttttgaatctatcgtctagggtatctgcctttcgcctgttagccacctaatgaaccctagagttgcccttatcaatgaattcatccttaggacttctaatcttcttagatttatttgtattcaccccctgattgcacttttatttacatgttctgttgattgcattttagttcttaaatttgttgcctgttggttctactcgacccaatgatcgagtagggctcttaagttcttatttttgctattcgaatcttgacgtaggattgttactagaaaccaaccatctctataatctggcttgacttagttgcttctgtacacatcttgattgctagcaataacagtggacaggattgacagcccctatagctgcatcgacatgttagtggttaagggtaattgaactgaacacaccacacttcagcacataagtaggcctaaaaaaactacttataagagtataagaagcaaaaccgcaacctgatcttaaatgcgtaggtagtgtttccttgttagtagatacaaagccaaagattcatacggactttggctacaccatcaatgctttgagaagcaagaagaagcttggttagtgttttggagtcaaatatgatttgatgtcatgtgtatgattgaatataaaactagaaccgcaaccgaatcttaaaagcctaagtagtgtttccttgtttaaaagatacgaagccaaagactcatacagacttcggctacaccatcaaagctttgagaagcaagaaaaatcttggttagtgttctggagtcaaatatgaattgtagtcatgtgtatgattatgtataagaactagaactgcaaccggatcttaaaagcctaagtagtgtttccttgttagaagatacaaagacaaagattcatacgaacttcggctacactatcaaagctataagacgcaaaaaaaaaaaagcttggttagtgttttggagttaaatataatttgatgtcatgtgtatgattgagtataagaattagaaccacaaccgaatcttaaatgcccaagtagtgtttccttgttagaagatacaaagtcaaagactcatacggactttggctacaccatcaaagctttgagaagcaagaagaagtttggttaatgttttggagtcaactatgacttcaggtcatttgtatgattaagtataagaactagaactacaaacgaatcttaaaaggctaagtagtgtttccttgttagaggatacaaagcaaaagattcatataaaattcggctacaccatcaacgctttgacaagcaagaagaagcttggttagtgttttggagtcaaatatgagtagatgtcatttgtatgattgagtataagaactagaactgcaaccgggtcttaaaagcctaagtagtgtgatatgtctataatttgcatgttttcagtgtccattcatcatcgttttgagtccagtttcgtatcattcatcacagtttatatcatttctcatcattcttgcatactttgcatgattaggataactttgcatacatattgcatttctgagttgttttcaggtgatttggagctgtttgcaagcaaattggaagaaacgagccagaaccagaagacatactcgacccccaggtcgagtgactttagagccattcttcccacatactcgacccccaggtcgagtgactttggagccattcttcccatccactcgaccaccaggttgagtaacctcagctcaggccactcgatgacactactcgaccccctggtcgagtatcacttcgccacactacctgacaacactcgaccgttcactctaccaagttactcgaccccctggtcgagtatcatcactcaccaccatcagcatcactcgaccggacactcgatcacgtcttcacagtctactcaaatccgcactcaaccagacaagctgagcacaaggaagagaagaggagaagacaaagtgtttggaagcggcctggacctccatcggatcaagaagcccatctcggcccattatctctctatgggccgagcgattaggttattggcccgtctattatcattttatttcgttttgtataaatagatgtcttagggttctgtcctgagacatctagtcgacattgagtttttgcttcagttttattttctgttttactctactgcgccggttttgcttcggcaacctgtaattcgagatttttcaaagttattcagattccgcatttgatttcatctgtcatcttgtttctctactctttatctctttacttatgcaatattatcgtttatttgcatttatgtcttttagcatgttgtctgagtagtgacttagaattcttagggataggatagagtagttgtggaatccgtagtctgtagaatggttaagttttagaattgattgaatccctttaggactagttgcgtttactgcttatttctttctgatcaattggaattcgatcccaagcattcccgcacccagaaggtgtttgatggaatgcttgatccactagttcctgagatatgcgtctctatcccaagggattggccgtttagagcgtttattgactttatcagtctgttcttattgcctgcatagttagattccgttaatgggaattagtctgggctagctttgcttgaggatttctatcacgggagtgaattgatctgttgttgaacctgttgtctagggatagcttgattgcgcttgttaaccattcgaataggctaggataccactctactcgattaccctatccttaggcatttctcgtctatcttatttctctgttttatcgttatcgcttaatcgttctcattgcctgtttcttagtttttacaatcactcgaccatcttactcgaccacacccagtgtctggcaacagactgtgcagtcgagtaagattatcttgtttcctgtctattactcgaccagtatactcgaccacacccagtgtctggcaacacactgtatagtcgagtatagctgtttcatatcctgtctgttactcgacctgttactcgagagattttagtaattctgttattgcttctaatttctgcatgttcgcttaggactgttagaaaccccaaaactgttattacttggcttgacttagtgacttctgatcacatttcatctatttgcatcacacccatttggattgacacctaaaatactacaacgacatgattggtgttttatgataattgaccataataacctattatcaatttggcgccgttgccaattgggtgtttgtttgctatatttgagatttcagaatatttaagatcaagttctttttaattttctctgaaagttactaactttgtgtttgtctgttttgattcaggtactacgaatcaccagcttcaccagttggtactcgttgtatgcaaacacggtcacgaggaaatcagaatctcctgttcaacgataacatcgaccgtattgcacaccaactcagagcacagacagaaacagacaaaatggctgcagttgttgatgagcaggtgcaaccaaacaacataggtgcaggcgatgcaccacgcaaccacaatcagcgtaatggcatcgtgcctccacctatgcagaacaacaactttgagatcaagagcggtctcattgccatggttcagaataacaagttccacggcctccctatggaggatccactcgatcacctggacgagtttgataggctctgcagcctaacaaagatcaacggtgtcagtgaggatggcttcaagctcagattgtttccattctctcttggagacaaagcacattagtgggaaaagtcacttcctcaaggctctatcacctcctggaatgactgcaagaaagccttcttggctaagtttttctcaaactccaggactgcgagactaaggaatgatatctccggtttcactcagacgaataatgagactttctgtgaagcatgggagcgcttcaaaggttatcagacgcaatgtcctcatcatggtttctccaaagcttcacttctcagcactctctacagaggtgtccttcccaagatcaggatgcttctagataccgcttctaacgggaacttcctcaaaaaagatgttaagacggatgggagctggtagagaacttggctcagtcggatggcaactataatgaagattatgacagacgcatccgcaccagctctgattctgatgagaagcaccgcagggaaatgaaagccatgaatgacaaactggacaagctactccttgtgcaacagaagcacattcattttctgggtgatgatgagacgttccaagttcaggatggggagactctgcagtcagaagaggtcagctatgtgcagaaccaaggaggttacaacaaaggtttcaacaacttcaagcagaaccatcccaatctgtcttacagaagtacaaacgttgtaaacccgcaggaccaagtctacccttcacagcagcagaatcaacccaagccctttgttccttacaaccaaggtcaagggtatgttcctaagcagcagtatcagggcaactatcagcagcaacttccaccacctgggttcacacagcagcaacaacaaccagcttcaacaactccagattcagacttgaagaacatgttacagcagattctccaagggcaagcaacaggagcaatggatttgtgcaaaagatggcagaaattcacaacaaggttgactgtagttacaatgatatcaatatcaaggttgaagcactgacatctaagatcagatacatagaaggccaaactgggtcgaccgcagcacccaaatttacaggaccttccggaaaatcaatgccaaatccaaaggagtacgctcatgctatcacacttagaagcggtaaagaattacccacaaaagagagtccgaaccagaacactgaggacagtgtagatcaagatggggaggatttctgtcagaatggagattccgctgaaaaagcaatagaagagcctatactcgaccaacctactcgatcactagctcctgcagcatttcctcttgttgaaaaaccagttgccgccaaaaccaaagacaacgtcttcgttcccccaccttacaagcccccactcccatttcctgggcgattcaagaaggtcatgatacaaaagtacaaagctctcctggagaaacaattgaaaaatcttgaagtcacgatgcctcttgtcgactgtcttgcacttataccagactctaacaaatatgtgaaagacatgattacagagaggatcaaagaagtccaaggaatggtggtgctaagtcacaaatgcagtgcgatcattcagcagaagatcattccaaaaaaactaggagatcctggttccttcaccttaccttgcgctcttggccctttagccttcagcaagtgcctctgtgatctaggtgcatctgtgagtctcatgcctctctctgtggcaaagaaactgggcttcaacaagtacaagccctacaatatatccttgatcctagctgacagatctgttaggattccccatggtctgctggaggacttaccagtcatgataggcatggtcgaagtaccgacaaactttgtggttttagaaatggatgaagaacccaaagaccctttgatactgggaagaccatttttagctacagctggagctatcattgatgttaagaagggaaaaatcgatcttaacctcgggagagatctcaagatgaccttcgatatcaccaacaccatgaagaagcctacgatagaaggaaatgttttctggattgaagagatggatatgttagctcacgaaatgctagaagagctgggagaaacagatcatctacagagtgctctaacaaaggatagcaaggaaggagatttacatttggagactttggggtaccagaagctgatagatgaacacaaagcagttgagaatccaggagagtatgaagatttgggtgaaagagcaagggaggaatatatactcgaccacatcactcgaccaacagcccattcggtgtactcgaccgagctactcgaccacaacaccttctctgagccaacttagtatccgatgactggtctgaactcaaggcacccaaagtagatttgaaaccgctaccaaaagggctaaggtacgtttttcttggactaaactctacttatcgtgtcatagtgaatgatgagctaactgctgatcaagtaaacctgctgataactgagctcaagaagtataggaaagctataggatattcgttagatgatattaaggggatttcacccaccttatgcacccatagaatccatcttgaaaatgaatcctactctagcattgaacctcaaaggagattaaaccctaacttgaaagaggttgtgaaaaaggagatacttaatctattagatgttggggttatctaccctatctctgatagcacttgggtatctccagttcattgcgttcctaaaaaaggaggtatgacagttgttaaaaattctaaagatgaactgatacccactaggactataactggacataggatgtgtattgactataggaagttaaatgctgcctctagaaaagaccatttcccattgcccttcattgatcagatactagaaagattagcaaaccatccttactattgctttttgtatggttatagcggattttttcaaatccctattcacccaaatgaccaagaaaaaaccactttcacttgtccttatgggacctttgcttacaagcgtatgcctttcggtctatgtaatgcaccagctacttttcagcggtgtatgacttctattttctcggatttgatagaggagatggtagaggtattcatggatgatttttctgtgtatggctgttccttctcctcgtgtttgttgaacctgtgtagggtacttaaaagatgtgaagagacaaacatggtgctgaactgggagaaatgccatttcatggttagagaaggcatcgttttgggccacaaaatttctgaggagggaatagaggttgataaggctaaggttgacgtgatgatgcagttacagccaccaaaaactgtcaaagacatcaggagttttcttggacatgcaggattttacagaagattcatcaaggatttctccaagttggcaagaccgctcaccagactgctgtgcaaggaaaccgagtttgcatttgatgatgaatgtttgacagcctttaagttaatcaaggaagctttgatcactgcaccaatagtccaaggtccaaactgggacttcccattcgagatcatgtgcgatgcttcagattacgcagtaggagcagtcttgggccagcggattgataaaaagctgcatgtgatctactacgcgagcagaacgatggatgatgcacaagtaaggtatgccactacagagaaggaactgctagctgtggtatttgcatttgaaaaatttagaagctacctagtgggttctaaagtgacagtctacactgatcatgctgctctgaggcatatatacgcgaagaaggataccaaacctaggctgttgagatggatcttattgttccaagagtttgatatggagatagttgataagaagggaattgaaaacggtgtagctgatcatctgtctaggatgaggattgaagacgaggtccctattgacgactccatgccagaagaacagctaatggcaattcagcaacttaacgagagtgctcaaattcggaaatcactcgatcaagtatgtgcaattgaagaaaagcttctgtggtatgctgatcacgtcaactacttggttagtggtgaagagcctccgaatctgtcgagctatgagaagaagaagttcttcaaggacattaaccatttctactgggacgaaccttatctctacacactctgcaaagataagatctacaggagatgtgtctcagaagacgaaatcgaaggcaccctattgcattgccatgggtctgcctatggtggccactttgcaacgttcaagacagtgtcgaaaatcctgcaagctggtttttggtggccatcaatgtttaaggatgctcaggaatttatctcgaaatgtgattcatgtcaaataagagggaacatcagtagaaggaatgagatgcctcagaatccgatcttagaagttgagatctttaacgtttggggaattgattttatgggtccgtttccttcttcttacgggaacaagtacatactggtcgcagtagactatgtatcaaaatgggtggaagccatagccagccgcaccaatgatgctagagttgtgctaaagctgttcaagacaattatcttccctagatttggagtcccgagaattgtgatcagtgacggagggaaacattttatcaacaaggttttttagaaccttttgaagaagcatggagtaaagcacaaggtagccactccttatcatccactgacgagcgggcaggtggaaatctccaacagagagataaaagcaattttagagaaaacagtgagaagtacaaggaaagattggtctgctaagctcgatgacgcactatgggcttacagaacagccttcaagacccctattggcacgactcctttcaacctcctctatggaaaatcctgttatttgtctgttgaactcgagtataaagccatgtgggcagttaaactcctgaacttcgacattaaaaccgccgaggagaagcggttgatccaactgaacgatctcaacgagattcgcttagaagcctatgagagttccaaaatctacaaggagcaaaccaagtctttccatgacaagaagatagtctcaagagattttaaggttggtgatcaagtgttgctgttcaactctcgcctgaggctttttccaggcaagctcaagtctagatggtctggtcctttctctgttactgcagtccaaccttatggtgttatcactctagctggaaagaatggagacttcacagtcaatggccagcggctcaagaaatacatgatagatcagtttattccagaaggaacctctgttcctttggaggagcctttaaacgcctaatgagtatgaggagtcaagctagagacctaaaacaagctcacttgggaggaagtcccaagcctacctttgtacatatctttcattttccttgttgtttttgatgcatcttgttagtgttttcaggagataagtttgaagagttgctggaaatagattctggctttgaaggaacagcaatacactcgaccacagagcaatcaaactcgacattgttctggcttcttcacaccaggaaatcactcgaccacaccctatagagaccgaatgacgatgtggtcgagtatagcgaatgatgtagtcacgacttctccagtcccgtagcttacgcgaccgcggtgctggccgcagcagaagaagagaggtcgagtatcatcatagcggtgctggccgcgacgaaggagcaaaagtcgagtacccccagggggaagctgagacacaacagggagattcttcgatggcctgggagcaatcacaggcagctattgacgaccaactccgctccttcttccactgaggtatgcacctcactccaccactgtaatataccatctcttgtttttattttgtttttgtgatgtgttttgtcctgagtactctcttccaaatttagtcacacagtggactgtgtgatttaagtttgggggagggctcaggaagtgtgtgttgcattgtatataatcttgagtctgcattcatctaaggcatagaaaaactaaaaaaattgaaaaatttcagaaaatggtttcacaaaaatagagtgttcatgtagttgcattgcatttaggattgagtctagagtgtttcgtttaggattgttgcatatgcataggggataatgatgagatagccttgtaagcattttggttcaccagataagctcagtgccctcgttgttagttgtttgatgcgttgtcattgaaattgaagtaaaactgcaccatgcctagattgctctactcgaccacactgttaggatctgatatgattccctatcaatttgaacttgaatctgatttagaattatcatgtcttggcatcgaatttgaactcatggataccctaaaatacttggattttcttactcattttaaccactcttgttgatccaagtagctgactctccttattagagcagttaacccatacccaaacctgaactttctttcaagccctatatcacttgtgagtgtttgtgaggtcttatttcgattgagcttggtagaaagtgttaggttcgtaacgacagagatagtgtctcatgtagttctagttcgcgttcttcggactagataggactaggtgggcgcttatatcatgggttgggatgtgtttaaaagaaaagagggaattcattgttgatgaggaaagggaaagaattctaggggaagtaagctaaagaagttagaaaaaaaatctagtaaaggttttgggaatgttaaagaaaagaatgaggttcttgttagctaaagaagaagggttaaaagcctttggttttaaagaaaaaaaaaaacaggaaccttagttgttaaagaaatccaaacccgctagatgtatcagagcgttgagaaagcttctccttgagttaagagaaaagaaaagaatgatatgaaaaagagtttgaaagattcatgagtgcaaagggtagagttaagttgggacaagagttgggattaccattagaacttcattgttatactctgggtagatgggatcttatctttgtatgcataacctgggacttacctttagcattctaccaaagctcaatcattcttgagggatcccctgttacttaagcctattctgttagggaccatctttgtctcttgaccttcaccttagccaaatgagttcattcatgatgcactgcttgattcacattccagaactaatgaatgttaaagggattggtagatttgaaagcatgtgtaggtcgagtataagagacggattgattgataacaaggcatgactaacgtttttgagtaatattcaatcatatcgcatcttaaaactaccaacttggacattgattttatttgctctatcatatgctttggttctgagtccccgccttcactcctctccttcaactatgtcttcttatttgcttgagggcaagcaaagactaagtttgggagagttgatatatctataatttgcatgttttcaatgtccattcatcatcgttttgagtccagtttcgtatcattcatcactgttttatatcatttctcatcatccttgcatactttgcatgattaggatagctttgcatacatattgcatttctgagtttttttcaggtgatttggagctgtttgcaagcaaattggaagaaacgagccagaacaagaagacatactcgacccccaggtcgagtgactttggagccattcttcccacatactcgacccccaggtcgagtgactttggagccattcttcccatccactcgaccaccaggtcgagtaacctcaggtcaggccactcgatgacactactcgaccccctggtcgagtatcagttcaccacaccacctgacaacactcgaccgttcactctaccacaccactcgaccccacggtcaagtatcacttcgccacaccatcaccatcactcgaccattcactctaccaagttactcgaccccctggtcgagtatcatcactcaccaccatcagcatcactcgaccggacactcgatcacgtcttcacagtctactcaaatccgcactcaaccagacaagctgagcacaaggaagagaagaggagaagacaaagtgtttggaagcggcctggacttccatcggatcacgaagcccatctcggcccattatctctctatgggccgagcgattaggttattggcccgtctactatcattttatttcgttttgtataaatagatgtcttagggttctgtcctgagacatctagtcgacattgagtttttgctttagttttattttctgttttactctactgcgccgcttttgcttttacaacctgtaattcgagatttttccaagttattcagattccgcatttgatttcatttgtcatcttgtttctctactctttctctctttacttatgcaatattatcgtttatctgcgtttatgtctttgagcatgttgtctaagtagtgacttagaattcttagggataggatagagtagttgtggaatccgtagtctgtagaatggttaagttttagaattgattgaatccctttaggactagttgcgtttactgcttatttctttctgatcaattggaattcgatcccaagcattcccgcacccagaaggtgttcgatggaatgcttgatccactagttcctgagatatgcgtctctatcccaagggatttgccgtttagagcgtttattgactttatcagtcagttcttattgcctgcatagttagattccgttaatgggaattagtttgggctagctttgcttgaggatttctatcacgggagtgaattgatctgttgttgaacctgttgtctagggatagcttgattgcgcttattaaccattcaaataggctaggataccactctactcgattaccccatccttaggaatttttcgtctatcttatttctctgttttatcgttatcgcttaatcgttctcattgcctgtttcttagtttttacaatcactggaccatcttactcgaccacacccagtgtcttgcaacagactgtgcagtcgagtaagattgtcttgtttcctgtctgttactcgaccagtatactcgaccacacctagtgtctggcaacagactgtgcagtcgagtatagctgtttcatatcttgtctgttactcgacctgttactcgaccacatcctacttctggcatcagcctgttgtggtcgagtgattttagtaattctgttattgcttctgttttctacatgttcgcttaggactgttagaaaccccaaaactgttattgcttggcttgacttagtgacttctgatcacatttcatctgtttgcatcacacccatttggattgacacctaaaatactacaacgacatgattggtgttttaggataattgaccagaaaaacctattatcatagtgtgtccttgttagaggatacaaagacaaagacacatagaaacttctgctacaccatcaaaggtttgagaatcaagacgaagcttagttggtgtcttggagtcaaatatgactagatgtcatttgtatgatagagtataagaactagaaccgcaaaaggacccaaaaatgtaaagtaatgtttccttgttagaagagacaaaccaaagactcatacggacttcggctacaccatcaaagcattgagacaatgaagaagcttgtttagtgtttgggagtcaaatataacttgatgtcatgtgtatgttttagtataagaactaaaaccgcaaccggatcttaaaagacaaaaaagtgtttccttgttagaagatgcagatccaaagacttatatggactttggctacaccattaaatatttgagaacaaagaagaagcttggttactgttttggattcaaatatgactagagttcatgtgtatgattaagtataagaactagaatcgcaaccagatcccaaaagctaaattagtgtttccttgttagaagatataaagccgaagattcatactgactttcgcaacaccatcaaagctttgagaagcaagaagaagtttggttagtgttttggtgtcaaatatgactagatggcatgtgtatgattgagtataagaagtagaaccacaactggatcttaaaagcctaagtagtgttttcttattagaggatacaaagccaaagactcataaaaacatctgttacaccattaaaggtttgataagctagaagaagcttagttggtgtgttggagtcaaatatgactagatgtcatttgtatgattgagtataagaattagaaccgcaaccggatcccaaaaggtaaagtagagtttccttgttagacgagacaaagccaaagactcatacaaacttcggctacactatcaaagaattgagcagcaagaagaagcttgtttagtgtttgggagtcaaatataacttgatctcatgtgtatgattgagtatgagaactagaaccgcaacaagatcttaaaagcctaagtagtgttttcttgtttaagatacaaagccaaagattcatacaaacttctgctacaccatcaaaactataagacgcaaaaaaaaaagcttggttagttttttggagttaaatataatttgatgtcatgtgtatgattgagtataagaactagaaccacaaccggatcttaaaagcccaagtagtgtatccttgttagaagatacaaagtcaaagactcatacggactttggctacaccaacaaagctttgagaagcaagaagaagtttggttaatgttttggagtcaactatgacttcaggtcatttgtatgagtaagtataagaactagaactacaaacggatcttaaaaggctaagtagtgtttccttgttagaggatacaaagacaaagactcatacaaacttcttctacaccatcaaaggtttgagaatcaagaagaagcttagttggtgtcttggagtcaaatatgactagatgtcatttgtatgattgagtataagaactagaaccgcaaaaggatcccaaaatgtaaattagtgttttcttgttaaaagatacaaagccttagactcatacggacttcggctacaccatgaaagcattaagaagcaagaacaagcttgtttagtgtttgggagtcaaatatgtctagatatcatgtgtatgtttgagtatatgaactagaatcgcaaccggatcttaaaagcgaaagacgtgtttccttgttagaagatgcatatccaaagactaatacggacttcggctacaccatcaaatctatgagaagcaagaagaagcttggttagtgttttggattcatatatgactagaggtcatgtgtatgattgagtataagaagtagaaccacaactggatcccaaaagctaaagtagtgtttacttgttagaagatacgaagccgaagattcacacggactatggcaacactatcaaagctttgagaagcaagaagaagcttgtttagtgtttgggaatcacaataacttgatgtcatgcgtatgattgaatattagaactagaagcccagcaagatcttaaaatcctaagtagtgttatcttgttagaagatacaaagccaaagactcatacagacttcggttacaccatcaaagcattgagaagcaagattaagcttgtttagtgtttgggagtcaaatatgtctagatgtcatgtgtatgtttgagtataagaattagaaccggaagcggatcttaaaagccaaagaaatgtttccttgttagaagatgcagatccaaagacttatacggacttcggctacaccatcaaatctttgagaagtaagaagaagcttggttactgttttggattcagatatgactagaggtcatgtgtatgattgagtataagaactagaatcgcaacaagatcctaaaagctaaagtagtgtttccttgttagaagatacaaagacgaagattcacacggactatggcaacaccatcaaaactttgagaagcaagaagaagcttggttagggttttggtgtcaaatatgactagatgtcatgtgtatgaatgagtataagaagtagaaccacaactggatcttaaaagtctatgtagtgtttccttgttagaggagtcaaagccaaagactcatacaaacttcttgtaacgcccgtgtcccgcaacaaggtctcacacttcttctacaccatcaaatgtttgagaggctagaagaagcttagttggtgtcttggagtcaaatatgactagatgtcatttgtatgatagagtataagaattagaaccgcaatcggatccgaaaaggtaaagtagtgtttccttgttagaagagacaaagccaaaaactcatacggacttcggctacaccatcaaagcattgagaagaaataagaagcttgtttagtgtttgggagtgaaaataacttgatgtcatgtgtatgattttatattagaactagaaccccaacaagaacttaaaatcctaagtagagatttcttgttagaagatataaagccaaagactcatacggacttcggctacaccatgaaagcattaaaaagcaagaacgagcttgtttagtgtttgggagtcaatgtaatgtgtatgtttaagtataagaactagaatcgcaaccggattttaaaagcgaaagaagtgtttccttgttagaagatgcatatccaaagacttatacggacttcggctacaccatcaaatctttgagaagcaagacgaagcttggttactgttttggattcaaatatgactggaggtcatgtgtatgattgattataagaactaaaatcgcaaccggatcccaaaatcttaattagtgtacccttgttagaagatacaaagcggaagattcacacggactttggaaacatcatcaaatctttgagaagcgagaagaagtttggttagtgttttggtgtcaaatatgactagatgtcatgtgtatcattgagtataagaactagaagcgcaaccggatcttaaaagcctaagaagtgtttccttgttaaaagatacaaagccaaagacacatacggacttcgcctacaccatcaaagctttgagaagaaagaagaagcttggatagtgttttagagtaaaaaatgactagatgtcatgtgtatgattgagtataagaactagaaccgcaacaagatcccaaaaggttaagtaaaagtagtgtttccctattcgaatatccaaaaccaaaaactcataaggacttcgtctacaccatcaaagcattgagaagcaagaagaagcttgtttagcgttttggagtcaaatatgactagatatcatgtgtatgattgagtataagaacttgaaccgctatcggattccaaaaggtaaagtaatgtttcgtagttagaagagacaaagccaaagactcatacggacttcggctacaccatcaaatctatgagaagcaagaagaagcttgtttagtgtttgagagtgaaatttgtctagatgtcatgtgtatgattgagtatacgaacaagaaccttaaccagatctgaaaagccaaacaaatgtttccttgttagaagatgtaaatccaaagacttatacgcactttcgctagaccatcaaatctttgagatgcaagaagaagcttggttagtgttttggtgtgaaatatgactagatgtcatgtgtatgattgagtataagaagtagaaccacaagtggatcttaaaaccttagtagtgtttccttgttcgaggatacagagccaaagactcatacaaacttttgctacaccatcaaatgtttgagaagctagaagaagcttagttggtgtcttggagtcaaatatgactagatgtcatttgtatgattgagtataataattagaaccgctatcggattccaaaaggtaaagtaatgtttcgtagttagaagagacaaagccaaagactcatacgaacttcggctacaccatcaaagcattgagaagcaagaagaagcttgtttagtgtttgggagtcaaacaaaacttgatgtcatgtgtatgattgagtataagaactagaaccgctacaccatcatgtggatcttaaaagcctaagaagtatttccttgttagaagatgcagatccaaagacttatacggacttcggctacaccatcaaatctatgagaagcaagaagaagcttggttagtgttttggtgtcacatatgactagatgtcatgtgtgtgattgagtattagaactagagccgcaataagatcccaaaagctaaattagtgtttcctggttagaagatacaaagccgaagattcacacggactttggcttcaccatcaatgctttgaaaagcatgaagaagcttggttagtgtttaagagtcaattataactagatgtaatgtgtatgattgagtataagaactagaaccgcaaccggatcccaaaagctaaagtagtgtttccttattagaagatccaaaaccaaaaactcatacggccttcggctacatcatcaaagcattgagaagcaagaagtagcttgtttagtgttttggagtcaaagatgactcgatgtcatgtgtatgattgagtataagatatagaaccgcaaacggatcccaaaagctaaagtagtgtttccttgttagaaaatacataaccaaagactcataaagactttactctacaaaaggcctagagatcgagtacacaatccagtggagtgcaaaatttttgaaaactttttgttgcacttggagaccttgcattctgttatcatcttgctattactcaattgctatcatgttttcattcttatcatcgtttatgctttatgcaatgatgtctgagtagtgactaggtttctgaggatgggttagagtagttagaattcgcagtatgctatgtggttgagtttgatttatagatcccttctggattagttgttcttaattgatatatccctatttttaccgtttttaattatgttttaggtttaggttttagagtctatttgttatttctagagtcttttctaatccttttcaggtctttacatgtttgggatgcatttggatattatggagcatcctagaaatcaactgacaacttaagctgcagaagcaatctggagacgaaaacgcacgtatttgagacgcaacttattgatgttttgaagattttcaaattcggcccagaactttctcctatgtttaattaaggcccaacacgttttaaagacatttatatagtttttaggtcattgttttagacctaagcttggagaggctattttatatctcttttgtactttgggagcaaaaccctgtagaaactccctttggatctttcttactcttttctcttgttattttcatcattgatttcttattcagactatgatttgtgtttctttgatcatgtctaagttatccacttgttaggtttagggtttctcattagggatttagatgatttagtagattgcccccttgttaggttatctgtaggattcttcatcttgattatgcttaatgttaattctagagtagctaactagaacttgatattagataataggtatgcccgccataggtacttgttatttgatccatcatagatgaacataggcatttaagaaagaacatgtaggctcatagaagggctcttctttagatactaggtgaactaatcaaacttgataataatgcatgctttagtttaggatttctcggcttctccggttatcttagctctaagtatagagagtttcgcggaatgccaccggttactctaaaatcatagtttgagtttgagaacggttcgataacaatttagttatttctagatctactatcatctatttcctgaaaattccctaaggctgacgcttttattatcttgttttacaaccatccaatcgattgctattgcttaattttgtttccctttattttatttagtgttttacttagcataattcgatttgccattagtctattgcgtgatccgagaactttgtgaattcaatccctaagtgctgcaaccgacctctttatttgagagagtggtcttaagattaatttgacctatatcaaatttggcgccgttgccgaagttctcttttattcaccattagactaggtgtagaatttagactagcttttatttttctttattttgtttctcacgcgttttctttcttctttttcctgtgacaagggagttaaaagatggaacgcaacaaactgctggcagatttcgacgatagtgtcgaccgacaccaactaggtgtcgatcgacaccatctgcagaacaaaccagctaccataggcgacttcaacagagctgatcttttctactccaatctatcagcgatccagctacctccttttgcaagagaagactttgctattcaccatctacagaacagaccagctaccataggtgacttcaacagagttgatcttttctactccaatctatcagcgatccgcctacctccttttgcaagagaagactttgctattcaccatgcctactatactcttgtttcacgatgaaagtttcgaggacattctaatgaatcaccactagatcatctggaagtcttcgaagacttagtgtcctcaatcaaagcagcaggtgtaccagctgattatcttctttgcaaactcttcccacattctctcgcgggtagaggaacattatggctgcgacagctagaaccaggttcactaaccaattggactgacacgaagaatgcattcatgatccacttccttgatgattcagtgacaaaattactgcaggagaagatctcttctttttctcaagctccaacagaaggtttgaaggcagcttggatcagattcaaatcctatcagagagaatgtccttatcatggtttccaagagagccaactcatcaatatcttctaaagagggataatcatgccataccagactcaacttgatgcagcaagctactgtaacttcatgacaagaactactagtgaagcattactcctcattaccaatgctttaactagtctttcgacacatgaatttgacaccgcaagcaaagagactcttgtttcagcaatttctgctccttcccaagccccccccccctcctccctcatcagagaccagaatggagtctatgtttacgcagcttcttgcaggcttcacaaaggttgatagcaaatatgattctctctccacaaagcttgaaagcaaacatgattctctctacacatatataaatagcaagtttgacaatctacgctctcatatctccgagctatcacctccattagcctctatcaatgcagtcacactacgcagcggaaagcaactcaatccaatacttcagcgcgaaagttcagctcggacttcatctattccagttgtaggaaatgtctcactgttaatcgatacatcagggtgtcgatcgacaccaattaatcttgacgactctgttttgactttgtcgagtggaatcgataatttcgtagaggaggcactaattctcgatggtatcgaacgacacccacctcatgtcgatcacaccaacaccaaacagacaggccagtgttgacatttgacagagcatgattgattccagacagtggtgtcgttcgacactcacctagtgtcgatcgacaatggactcagacaccacctatatgccttgcatctccacctgtcactagacaagtctacacaccacaagttccttgtctactgccttgagtgtctaagcatgagattcctgagatgcattgcatgggtatcatggatgagactctacttcagttgcctccggttgatatagataagttatcaccccctcttcagagtgatatgctacgagatgatgctccagagaattaagatgacaagacaaagataatggttgtctcagaacaggtactcaacaacaccaagcgtccacatgaagcaagctccagattcgttgttgagaatcgatctatagagatggctaagccggagttctttgttagagctagttttcgggttgagtttagtgatgatactccaggcactacagccacgtctcccaccgcacctctaccctttgctccacctccgaaacggcaaagctactcacctcctaatttcgtcaataagtgtttcaaatctccaaaaactgcaggttccacttaatccgactattaaaaaatctctaccctttggaatcatgatctatatttctttagattattgtctagttgacgaatgctgcaggttccacttaatccgactattaaaaaatctagatagcaaaccaacacacttgaggatatcctagtttccaactcaaccactaaggctggagctaatctcacagctcttcgtattacctcttcaaacggttagtattcatagatattgacttcggctacaccatcaaatctttgagaagcaagaagaagcttggttagtgtttttgtgtcaaatatgactagatgtcatgtgtatgattgagtataagaagtagaaccacaactggatcttaaaagcctaagtagtgtttccttgttggaggatacaaagcaaaagactcatacaaacttttgatacaccatcaaaggtttgagaagctagaataagcttagtatgtgtcttggagtcaaatatgactagatgtcatttgtataattgagtatgagaattagaaccgcaaccggatcccaaaaggtaaagtagtgtttccttgttagaagagacaaagccaaagactcatacggacttcggctacaccatcaaagcagtgagaagcaagaagaagcttgtttagtgtttgggagtcaaatataacttgatgtcatttgtatgattgagtaaaagaactagaaccgcaacaagatcccaaaagctaaattagtgtttccttgttagaagatacaaagccgaagattcacacggaatgtggaaacgccatcaaagctttgagaagcaagaagaagcttggttaatgttttggtatctaatatgactagatctcatgtgtaacattatgtataagaactagaaccgcaaccggatcttaaaaccttaagaagtgtttccttgttagaagatacaaacccaaagacacatactgaattcggcaacaccatcaaagctttgagaagcaagcagaagcttggatagtgtttttggagtaaaaatgactagatgtcatgtgtatgattgagtataagaactagaaccgcaaccggataccaaaaactaaagttgtatttcattgttagaaaatacaaagccaaagactcatactgccttcagcttcatcatcaatgctttgagaagcatgaagtagcttggtttgtgattaagagtcaattataactagatgtaatgtggatgattgagtataagaactagaacttcaaccggatcccaaaagctaaagtagtgtttccctattagaagatccaaaaccaaaacctcatacggagttaggctacaccatcaaagcattgagaagcaagaagaagcttgtttagtgttttggagtcaaatatgactagaggtcatgtgatgattgagtataagaactagaaccgcaaactgatcccaaaagctaaagtagtgtttccttgttagaaaatacaaagccaaagactcataaaaacttctacttcaccatcaaagatttgagaagcatgaaaaagcttggttagtgttaaggagtcaattataactagatgtgatgtgtaggattgagtataagaactagaactgcaatcggatccaaaaagctaaagtagtgtttccttgttagaaaatacaaaccctagacttatacagacttcggctacaccatcaaagcattgagaagcaagaagaagcttgtttagtgtttgagagtcaaatttgagtataagaactagaaccacaaccgggtcttaaaagccaaacaaatgtttccttgttagaagatgtaaatccaaagacttataccgacttcggctacaccatcaaatctttaagaagcaagaagaagcttggttactgttttggattcaaatatgactagaggtcatgtgtatgattgagtataagaactagaactgcaaccggatcccagaagctaaacttgtatttccttgtttgaagatacaaagacgaagattcacacggactttggtaacaccgtcaaagcattgagaagcaagaagaagcttggttactgttttggagtgaaatatgactagatgttttgtgtatcattgagtataagcactagaaccgcaaccggatcataaaaccccaagaagtgtttccttgttagaaaatacaaagcggaacacacatacggacttcggctacaccatcaaagcttagtgaagcaagaagaagcttgggtagtgctttggagtcaaaaatgactagatttcatgtgtatgattgagtataagaacaagaaccgcaatatgatcccaaatgctaaagtagtgtttccttgttagaaaatacaaagccaaagactcatacagcctttggcttcaccatcaaaggtttgagaagcaagaagaagcttggttaatatttaggagacaattatagctagatgtaatgggtatgattgagtgtaagaactagaaccaagggctgtgagacccagtcccggacgtctcggcgtccggcgaccgtgtactcaagtttgcgccttctcccggccgaacctcttaattttttgcgattaaccatagaattgcctttacgaggctaaattctatatttgctttcttattacacagcggaagtctttctaaccttggtttaatacacatcgttggagccatgttgtagttaacaatcaaaactggccaggtgctatacttagtgttttgaatagagaacggattcatcccatcagtagaaagtcccaatctcaggtttctagcttcagcagcaaattgtggccatttatcattcacttgagcccaagccaaagagtctacaggatttcgcattgtaccatcatcactagcattactgaaatgccaccgtagatcctcggccattttcttggatctaaacattctcttaaatctatccttgattggaaaatacctcagtaccttagctggaatccccttcttctcttcacctgtgtgtttatccctttcccatctggaagcattgcatcttggacaagtatccctcagctcatactcctttctgtataagatgcaatcattctgacaggcgtgaatgatatcatacccaaaaccaaacatcttcaggatgtttgatcactaagctcatttgatcttagtgatctcatttgttgatgttggcagcacattctctcctggtagtatgtcgtgcactaagctcaaaagttgatcaaaataattctctgacatcccactcttcactttgatgcggtaaagccccataattgcagacaccttagtgtacttcggacagccatgatatagtggagtttcagcttcctttaacttctccctaaaatcagcttcttcttttgtttctggctccttactatcatcttcattctgattctgagaatcagaatggacgtctccatcaaaataaactgttctaatcagctcataagcttcacattcactagtagtactactaggctcaacttctaacttatcagctcgtatctccccatgcttactccaacaactatttctcttgtatttatggtccattcccttaataactagatgctccaaaatagtctcaattggttgatgacacagattccggcaatcaatacatggacaaaacatttcagcatgatctcccagacttctcgatgatgcgtaaacaaaagttgttgctcctttctcatactcaatgctattccttggcagccatacccatgacttatccatttttaaaagaccaccaagctccaaccccatatatatgatattacttatatatatatatatatatatattagcattcagctatataagcaaacaaaactcaaagagcaaagacaaaatgagaaatttcataaactcaagttcactatcaattcaagttctgtgttattactcaagttcaaattcaaaatcaatactcaagttcaaaatcgatacaagtgaatactcaaggtcaattttataagaaacacaaatcgatacaagtgaatactcaagttcaaagctatatgacattcaaaatcgatacaagctaagtgaatactcaagttcaattctattagaaactcaaatcaatacaagtgaatcctcaagttcaattctgaaagaaactcaaatcgatatatgcaaactaagaactacagaaatctattcaaactaagtcaaaataacatacctgtcaaatagaaaccattgaaatcttcgagacacggctaccaaaagcttctgagaacctgaaaacgaaaccctaaaactgattaaaaccccaaatcgatgctcaaacaagagaatttggacatgcaatccctaaatcgattagaaaaggcacataaccttctcaaattagaaacagatctgtgactgagaagctaaggagtagcgagagtcgtcaagagagattgaatagagtcgttgagcaagaacacgaacacaaagtgagacagagagaagaagaatcgattagagcagaacatgaatagggaagaacacgaatagggagggaaacagtcgagaaagaacacaaatagttttttcacttagaatatttttaggctaatttttttgtttcggcggcaacaaaattaatccgcgctattacattaggtagcgtttaattaatggtaatgctatagaacaataaccctaaattcaaaaacatgacccgcgtcattttttatttaccgggtacgagattatagcgttgtgaaattaccaaacgctataaaagtttagccggttataaattatagcacaacatggttaactgctatattatagtgctataaataatccatattcttgtagtggttccaaaaagctaaagtaatgtttccttgttagaagatacaaatccaaagagtcatacggacttcggctacaccatcaattctttgagaaacaataagaagcttggttagcgttttggaataaaataaaactagatgtcatgtgtatgattgagtagaggaactagaactgcaactggttcccaaaagctaaaatagagtttccttgttagaagatacaaacccaaagaaccatacgaatggctacaccatcataactttgagaagcaataagaagcttggttagtgtctgagagttaaatacgaccagatgtcatgtgtatgacagagtataagaacttgaactgcaaccggttcccaaaagctcaagtagtggttccatgttagcgatacaaaacaaaagcttcatacggacttcggttacaccatcaaatctttgaaaagcaattaaaagtttggttagggttttggagtcaaatatgactagatgtcatgtgtatgattgagtataagaactagaaccgcaatcggttcccaaaagctaaagtagagtttcccttctaaaagatacaaagccaaagactcatactgacttcggctacaccattaaagctttgagaagcaataagaagcttagttagtgttttggagtcaaatatgactagatgtcatgtgtatgattgagtataggaactagaaccgcagccgattcctaaaagctagagtaatgtttccttgttagaagatacaaagccaaagagtcttacggattttggctacaccatcaaagctttgagaagcaataagaagcttggttggtcttttggagtcaaatatgactagatgtcatgtgttcgattgagtaacagaaatagaatcgcaactggttcccaaaggctaaagtagtgtttccaagttagaagatacaaagccaaagactcatacgtacttctgctacaccatcaaagcttttagaagcaatagaatctttgttagtgttttggagtcaaatatggctagaggtcatatgtatgattctatataagaactagaaccgcaatcggttacgaaaagctaaagtagtactgtttccttgttagaaaatacaaaccatgagactcatacgaacggctacccatcaaagctctgagaaaaaataagaaggttggttagtgttttggagtcaaatataactagatgtcctgtgtatgactgagtataagaaatagaaccgcaatcggttctcaaaagctaaagtagtggttccttgttaaagatacaaagccaaagactcatacggatttcggctacaccatcaaatctttgaaaagcaataaaaagcctggttagtgttttggagtcaaatatgactagatgtcatgtctatgattctatataagaactagaaccacaattagttcctaaaagctaaagtagtactgtttccttatactcaatcatacagatgatatctagtcatatttaactccaaaacactaaccaagcttcttattgctcatacactttgatggtatactaacaagaaaacattatttttgcttttgggaacagattcatgttctagttcttatactaaatcatatacatgacatctagtcatgtttgactcccatacactaaccaagattcttcctgcttctcaaagctttgatggtgaagccgaagtccgtatgagtcattgtcttcgtatcgtctaacaaggaaacactactttagcttttggaaccgtttgcggttctagttcttatactcaatcatacacatgacatctagtcatatttgactccaaaaaactaaccaagatccttattgcttctcaaaaatttgatggtgtagccgaagtccgtatgcgtctttggctttgtatcttctaacaagaaaacactactttagcttttgggaaccagttgcagtcctagctgttaaactcaatcgtacacatgacatctagtcatatttaactccaaaacactaaccaatcttcttattgctcataaactttgatggtatagccgaagtccgtatgagtcttttgctttgtatcttctaacttggaaacactactttagctattgggaacctgttgcggttctagttcttatactcaatcgaacacatgacatctagtcatatttgagtccaaaaaactaaccaagcttcttattgcttctcaaagctttgatggtgtagccgaaatccgtaagagtctttggctttgtattttctaacaaggaaacattactttagcttttgggaaccggttgcggttctagttcttatactcaatcatacacatgacatatagtcatatttgactccacaacacctatcaagcttcttattgcttctcaaagctttgatggtgaagccgaagtccgtacgagtctttggctttgtatcttctaacaaggaaacattacttaagctttcaagatccaagttagattctagttcttatactcaattatacacttgacatatagttatattttacgctaaaacactaagcaagctttttattgcttttcaaagctttgatggtgtagccaaaaatccgtatctttagccgaaaaccattaatttagcttttggaaactggttgcagttctagttcttaaacttcctcttgcttctcaaagccttgatggtgtaccaaactccgtaagactctttggctttgtatcttctaacaaggaaacattactctagcttttaggaatcggctgcggttctagttcctatactcaatcatacacatgacatatagtcatatttgactctgaaacactaaccaagctttttattgcttctcaaagctttgatggtgtagccgaagtccgtatgagtcttaggctttgtatcttctaataaggaaccactactttagcttttggaaaccagttgcggttctagttcttatactccatcatagacatgacatctagtcatatttgactccaaaatactaaccaagcttctttttgcttttcctaactttattggtgtaaccgaagtccatatgagtctttggctttgtatcttctaacaaggaaatattactttagcttttgggaactggttgcggttctagttctaatactcaatcatacaaatgacatctattcatatttcactccaaaacactaaccaagcttcttattgcttctcaaagctttgatggtgtagccgaactctatatgagtcttttgctttgtaccttctaacaaggagatactacttaggctttcaagatccagttgagattctagttcttatattcaatcatacacatgatatgtagtcatatttgactcttaaacaataaccaagctattttatagcttctcaaagctttgatagtgtagccgaagtccgtatgagtctttggctttgtatctcctaataaggaaccactactttagcttagtgtagccgaagtccgtatgagtctttggctttgtatctcctaataaggaaccactactttagcttacggaatccaattacggttgtagttcctatacacaatcatacacatgacatatagttatatttgactccaaaatactaaccaagcttcttattgcgtttctaagctttgatggtgtagccgaagttcgtatgagtcttttgctttctaacaaggaaacaatactttaggttttgggaccggttccggttctagttcttatactcaatcatacaaatgacatctattcatatttgactccaaaaaactaaccaaccttcttattgcttctcaaagatttaatggtgtagccgaactctgtatgaatcttttgctttgtatcttcttacaaggagatactatttaggctttcaagatccagttgagattctagttcttatactcaatcatacacatgacatgtagtcatatttcactctgaaacattaaccaagctttttattgcttctcaaagctttgatggtgtagctgaagttcgtatgagtctttggctttgtatcttctaataaggaaccactactttagcttatggaaactagttgcggttttagttcttatattcaatgatacacatgacatctagtcatatttgactccaaaatactaaccaagcttcttattgcttttccaaactttattggtgtaaccgaagtccgtttgagtctttggctatgtatcttctaacaaggaaatactactttagcttttgggaattggttgcggttctagttcttatactcaatcatataaatgacatctactcatatttgactccaaaacactaaccaagcttcttattgcttctcaaagctttgatggtgtagccgaactctatatgagtcttttgctttgtatcttctaacaaggagatactacttaggctttcaagatctagttaagattctacttcttatactcactcaaacacatgacatgtcgtcatatttgactctgaaacaataaccagcttttttatagcttctcaaagatttgttggtgtagccgaagtcaatatgagtctctggctttgtatcttctaatacggaaccactactttagcttatggaaaccaattgcggttttagttcttatactcaataatacacatgacatctagtcatatttgactccaaaatactaaccaagcttctttttgcttttcaaagctttgatggtgtagcagaagtccgtatgagtctttggctttgtatcctttaacaacgaagcaatactttagcttttcggaaccggttgcggttctattccttatactcaatcatacacatgacatctcgtcatatttgtcccaagacactaacaaaacttcctcctgcttctcaaagctttgatggtgtaccaaactccgtatgagtcttttgctttgtatcttctaacaaggagatactacttaggctttccagatccagttaagattctagttctaatactcaatcatacacatgacatatagtcatatttgactctgaaacactaaccaagctttttattgcttctcaaagctttgatggtgtagccgaagtccgtatgagtcttaggctttgtatcttctaataaggaaccactactttagcttttgtaaaccagttgcggttctagttcttatactccatcatacacatgacatctagtcatatttgactccaaaatactaaccaagcttatttttgcttctcaaagctttgatggtgtagccgaactctatatgagtcttttgctttgtatcttctaacaaggagatactacttaggctttcaagatccagttaagattctatttcttatactcactcaaacacatgacatgtagtcatatttgactatgaaacaataaccaagcttttttatagcttctcaaagatttgatggtgtagccgaagtccatatgagtctctggctttgtatcttctaatacggaaccactactttagcttatggaaaccaattgcggttttagttcttatactcaaaattacacatgacatctagtcatatttgactccaaaatactaaccaagcttctttttgcttttcaaagctttgatggtgtagcagaagtccgtatgagtctttggctttgtttcctctaacaaggaagcaatactttagcttttcggaaccggttgcggttctagtccttatactcaatcatacacatgaaatctcgtcatatttgtcccaagacactaacaaaacttcctcttgcttctcaaagctttgatggtgtaccaaactccgtatgagtctattgctttgtatcttctaacaaggagatactacttaggctttcaagatccagttgagattctagttcttatactcaatcatacacatgacatatagtcatatttgactctgaaacactaaccaagctttttattgcttctcaaagctttgatagtgtagccgaagtccgtatgagtcttaggcgttgtatcttctaataaggaaccactactttagcttttggaaaccagttgcggttctagttcttatactccatcatacacatgacatctagtcatatttgactccaaaatactaaccaagcttctttttgcttttcctaactttattggtgtaaccgaagtccgtatgagtctttggctttgtatcttctaacaaggaaatactactttagcttttgggaaccggttgcggttctagttctaatactcaatcatacaaatgacatctattcatatttcactccaaaacactaaccaagcttcttattgcttctcaaagctttgatggtgtagccgaactctatatgagtcttttgctttgtaccttctaacaaggagatactacttaggctttcaagatccagttgagattctagttcttatattcaatcatacacatgatatgtagtcatatttgactcttaaacaataaccaagcttttttatagcttctcaaagctttaatagtgtagccgaagtccgtatgagtctttggctttgtattttctaataaggaaccactacgttagcttatggaatccaattacggttgtagttcttatactcaatcaaacacatgacatatagtcatatttgactccaaaatactaaccaagcttcttattgcttttccaagctttgatggtgtagccgaagtccgtatgagtcttttgctttgtatcttctaacaaggaaacaatactttaggttttgggaccggttccggttctagttcttatactcaatcatacaaatgacatctattcatatttgactccaaaaaactaaccaagcttcttattgcttctcaaagatttgatggtgtagctgaactctgtatgaatcttttgctttgtatcttctaacaaggagatattatttaggctttcaagatccagttgagattctagttcttatactcaatcatacacatgacatgtagtcatatttgactatgaaacattaaccaagcttattattgcttctgaaagctttaatggtgtagctgaagtccatatgagtctttggctttgtatcttctaataaggaaccactaatttagcttatggaaactagttgcggttttagttcttatattcgatcatactcatgacatctagtcatatttgactccaaaatactaaccaagcttcttattgcttttccaagctttgatggtgtagccgaagtctgtatgagtcttttgctttgtatcttctaacaaggaagcactactttagctttttggaactggttgtggttctagtccttatactcaatcatagacatgacatctagtcatatttgtctccgaaacactaacaaatcttcttcttgcttctcaacgctttgatggtgtagccgaactccgtatgagtcttttgctttgtatcttctaacaaggagatactacttaggctttcaagatctagttgagattctagttcttatactcaatcatacacatgacatatagtcatatttgactctgaaacactaaccaagctttttattgcttctcaaagctttgatagtgtagccgaagttcgtatgagtgtttggcattgtatcttctaataaggaaccactactttagcttttaggaaccagttgcagttctagttcttatactcaatcatacacattacatctagtcatatttgactccaaaatactaaccaagcttcttattgcttttccaaactttattggtgtaactgaactccgtatgagtctttggctatgtatcttctaacaaggaaatactactttagcttttgggaaccggttccggttctagttcttatactcaatcatacaaatgacatctattcatatttgtctccaaaacactaaccaagcttcttattgcttctcaaagctttgatggtgtagtcgaactctgtatgagtcttttgctttgtatcttctaacaaggagatactacttaggctttcaagatcaagttgatattctagttcttatactcaatcatacacatgacatgtagtcatatttgactctgaaacaataaccaagctttttaatagcttctcaaagctttcatgggttagccgaagtccgtatgagtctttggctttgtatcttctagtaaggaaccactactttagcttatggaaaccagttgcggttttagttcttatactcaatcatacacataacatctagtcagatttgactccaaaatactaaccaagcttcttattgcttttccaagctttgattgtgtagccgaagtccgtatgagtctttggctttgtatcttctaacaaggaaacactactttagctattgggaaccgattgcggttctagttcttatactcatcatacaaatgacatctattcatatttcactccaaaacactaaccaagcttcttattgcttctcaaagctttgatggtgtagccaaacgccgtatgaatcttttgctttgtatcttctaacaaggagatactacttaagctttcaagatctagttgagattccagttcttatacttaatcgtacacatgacatgtagtcatatttgactctgaaacacgaaccaagctttttattgcttctcaaagctttgatggtggagccgaagtccgtatgagtctttggctttgtatcttctaataaggaaccactacttctgcttatggaaaccagttgcggttttagttcttatactcaatcatacacatgacatctagtcatatttgagtccaaaatactaaccaagcttcttattgcttttccaagctttgatggtgtagccgaagtccgtatgagtctttggctttgtatcttctaacaaggaagcattactttagcttttcggaaccggttgcggttctagtttttatactcaatcatacacttgacatctagtcatatttgtctccaaaacactaagaaagcttcttcttgcttctcaaagctttgatggtgtagccgaactttgtatgagtcttttgcgttgtatcttctgacaaggagatactacttaggctttcaagatccagttgagattctagttcttatactcaaccatacacaggacatatcgtcatatttgactctgaaacactaaccaagctttttattgcttctcaaagctttgatggtgtagccgaagtccgtatgagtctttggcattgtatcttctaataaggaaccactagtttagcttatggaaaccagttgcggttttagttcttatactcaatcatacacatgacatctagtcatatttgactctgaaatattaaccaagcttcttattgcttttcgaagctttgatagtgtagccaaagtccgtgataactaggtttttatgcctagttatttgcagaagtgtggtgtgttcagttcaattccctttaaacactaacatgtcgatgcagctatagggggtgtcaatccagtccactgttattgctagctatcaaaatttgtacagaatcaactaagtcaagccaaattatagaaatgattggtttctagtaacaatcctaggtgaggattcaaacaagcaaaaatatgaacttaaaagccctactcgatcattgggtcgagtaataccaataggcaacaaatttaagaactaaaatgcaatcaacaggtgacacaaattacaggtaaatcaaagtgcaatcagggggtgaatacatataaatctaagaacaatagaagtcctaaggatggattcattgataagagcaactttagggttcatgaggtggctaacaggtgaaagggagataccctagacgatagattcagaaaccgggtcaatccattctcgtgaccgagacccccgtaactctacaacttcctaatctcaactttcgttgatgaaacatagcaaaacagggtttagaaccaatcaaccaaattcaataagcagtctagccaaactccttgtctagagtctacaaatctctggtattcgtagatccggaatccatttgaacgtcttttggacgctggatacctatggtcgaatgtctacattagccagcgaaaaccgcataggggccaacgaatccagaagggatctaacctaatcttaaccacctgactaacctagagattaccctaatcttattcatcctcaagaaccctaatcactactcaagcaacatactcaagaacacaaacccagaaattattgaaatcatatcaaaatgtagatctaaacaagctaaacgacattacttaaagaaccaaatgcaaaaacgaaatagattaagagtaattaagttttgaagattcaagaacacaaagaaaaactaagagataaaagctagatcctttggacaaatcccaaagtgatctatttatactaaagtattgaaaaccctagatttactagaagacaagagacttgaggatgtttgggcgagtgctcgatcttggggatcgagtaaagagggtgctgcaaagtctgcgcctttgtgtccatgctccgagtgatcaattggtcaagtagttgcttcttcctctcctattcttatgctcaaatgtcttgttgggaatcaggagaatcagaagacgctttgaatgatcaacaagtcttgtagagtaggttgcccttgctcgagtaaactggtcgattagaggattgagaaggagggtcgagtaaagtctgctgcctcctccatggctgcctagatcgagtaaaccggtcgagtagaatgctcttatgcttccctcctggtttgatagagtagagggtcgagtagaatgccttgtaagctctttctgcacctgaaaacacaccaaaacatgcaatatgtatgcaagatgatcctaattgcctaagtgtgcaaaataagctaaatgtgatgcaaaatgatttgatataatgagtgatcactaagctaaatgatgataaatacacacctaaaatgagtaaattacagtgttatcaactcccccaaacttatctcttgcttgccctcaagcaaacaaaaaatcttaaattgaagaagaggtttgaaggtggggattcaaaaaccgaagcatgcatatagaactggtaagctaaatgttcaggtagctaattctaggttgcaagatgatagacccttacttaaaaactttagccatactcgtcacaatgcaacctaacaacctgccttaaccaattccctttaacattcattaagcacgaacaatggatcaagcaatgcaatggttatgaactcaattggtttcaggcttaggctaagagacaaaaatggttcctctaatgattggtcgagtaacaggagacactcagagaaaagattgagctttagtagaatgctaaaggtaaaatccaatggaaacatacaagaatagactcccatctacccaatgatatcgtatgatagctcagaagatgatcccagtcctataggtgtcctaactctaccctttttctcattctttctctttttggttcaagttgtaaggggttcttctttaaaacgattcaagagtctagcgggtttggttttaaactttgacacacttaaggcttttcttctaatcttagcatatagggcgtttacccttttctttgaattacaatgcctaacttctttgaattccaaaccctttactacactaacactttttgtatcccccttaagaactctaaacttttactctcttttttttttctttttttttcattcccattctcttttccaatcattccatacatcatcccaatcccaaatacaagtcaccacctagtcctagctaactcaaaaagcgtcggctaggtctacatgaaagactggtcttgtcggctcatacctaacacgttataccaagctcaatcgaaaaagacctcacaatcacacacaaatgatctttagcttgaaattaggctaggctcaaggtattggaaactgctctaaaaatgagagtcaactacttggattaccaaagggtggtgaagtgaataagataatccaagtatgtatatggtagccatgagttcacaaacaatgcatatacatgataattgcaaatttagttcaggttctaatagatagggaatgacatcagataagcgagtttcgaatcaaagcagtatagtcaagttgtaaattcaaagcagggagcggtcttacttcagagaaccaatcggttatgcaaaagaaaactaacaacctcggcattgaacttacttcattgaatcaaaacatacttaacggtttgaaatcatcattatcccctatgcaaattagcaatcctaaatgcaaacactctgtatacaatcctaaaatgaaacttaaattacacagtcccttgtgtaataaaaatcggagaaagaattcaagaccaaaacacaaaacacacatagaaaaataaaaatgctatggtatgtacaatggtggtggtggtgttacctcagcggtcaggtgaagtagatgaaaacttaatcgtccatactctatagaatataagaaggggcagatgttgacgcgggaggattttgctcgttctgtctggtcgagtagttggtcgagcgtgtagaacctcgtctctgcctactccttggctctctcaactcggagatcacttcccgaggctcgagtgatgaagctcggggttgatcaatcctttcagccctcctttcagccctccttgtggaaccgcttcttcttacttcgggggtgggagacggtggccttggcttgctctagaagtctttgatttgactagccatactctttagtgatttcttcattgttctcatcttcttcttgaaacccttcatcgttttgctgtgaaggttcccaagctcttcaagcacacggagcttcttgtaaacttcagttatctcatctcctccttgatcagcatctgcttcataatgagcttgcttgaattctttggtctcttgctccggttgttcgctaagttgctcgaactcgacttgctgctcatagtcagcttgagtataatattcttgttgctcatagtcagcttgagtatactcttgttcatcttctctagctccttcgatgtcgatgttcagggaagagggagatggcatgaagttgatgttgtgccttgtcttcaatgaagtccggttctcgcaaggtagaggtaacaaagaaggtccaagctttggatggttgaacttgaagatataatgatccgccggagtcttcttttcaagaaaatccttccccttgagatagttgaggtcgatgaacttggggaacacgtcaggggttccaaattgtatccttgaagctcctaagattggtgttaagagaccaccaacacaaagacttccgcaaatccccgagagatggatggttgcaacatactctctatagctcagtaggtggtccaaaagaacgacagtcaacgaagtgtctactctatcacccgccatcttcctcccatcctcggtctctctcagaatgaagaccaaagcttgagcaatcatgaatagctctccttcataaacgaatctggtagtcttctttgggaaaagggtaatggcgatacattggtggaggtatctaatcacgagacttcgaattgaagaactcttgctcttggcgggcgagtagggctttggaccggcaattgttgtccaaagagattttatctcatcttggtcatagtcttggcggattctttctccacttggaaacccaaaaatggtatcaaggtggctaatatcaagctcgacacccccaaccttgaaatttatgtaaccaagccctcctctttcttctttctccgaatcatcaacacaaaagtgaaccttgagggttgaaaggagttggcagctctcctctttaaatcctccacattggcagctcatgaacgttgcaagattggccaattccatgaagtattccacatcaccacaaataccaagctcaaactttaactccttcaagtattgatagtactcacttggggttggctctctcttcctccttggtcggtttcttttgccaaccggggctagtgtatcatccccgatgatctcaacctcttcctcatgaccgcttcttcgaagactgcctcttcacggtgtacttcctcaacctcaacaaccctctttccccgagctacttcttctcttaacatggctgagcggcttgagcttccacctagaatcaagcttgatctttgagcacaacgatcttggcaaatttggcgttcagtcatgccactcatgtcaaacgcctcaacttcttcgttatcaacggaggatcttctaccccgagatgaactctttctccttgaatccatggagattggtggtgagcttcaacagggcaaacaagaacaactctccaaggggtatcaaagtggaatggattcggtttctttggtgatgaaattttgtgcttaaaaccgattaaatgtgtgaggatagacttgggagtgatcgagtaactttggtgaagtattggtgaaggtgagaacgaattcttgaagagtgatagggagagtttgggatgaaacttttgaagctttgtgagagatagagaattgcaaaaatgagatgatgaaagagagagtttcaaaagggtttggcgaattcaattcaatgggtggaggagaatggtctttggtttgtttttggaagagatagaaacgttgattggaaatggtgaggagcatgggtaatttctttgtccatcgagtaaaggagtgttgggggaataagtggggtcacacaacttcactccttggtctccaaataattcaagctcgagtaaaggatcaagcatcttctagaattacgcattactcgatcgaacggtggagaattc

SEQ ID NO: 212 - DNA, 163317 bp, Arabidopsis thaliana
gaattcgaaattaggttaaatattctaaatttatttaaataactggaaaaataattttaactaaattattttttatgtttgataattaaaatagaaaatatatgtttaaacatttaaaaataagattaattacatttttggtttatattaatttttgttaattatattaattgaattccttttgcagcaactgaatcatattaatttaaaatattcaatgcgtatattcctttcttaaatttaaatatatcacttctccataattatagctaatcaaatattcagttggatattcatttttgaagttaacataaagtttccggacaatttccataattaaataactacttataagataattgctaaacattctcttataattatgagatttattataatcattaaacttgacttccacgatttaatattttattcatattttttacctaaaaatttatatcttataaatactgtacgtcccatttcaagaactcactcagcagttcctattttcttttactctctcgcctctttttttattcaagcagaaaaaaacgagaccatgaagaaaactgaggttgtggatcgactagaccatggagaaagcaatatatcgaggtgtcctctcacactctctgtttttctctatttttttcatgtttttctcacatcttttttttataatatttatgcaggtaatgtggaagattaaaatgtagacgcacacatgattttgttaaagtatgtcttgctttctaattatttatcttttatgcaaagtaatatgttaacctttttttacctctctatatatttataagatgagtaattctgattgaattttttgatagggattacggtctttttcctgttaatttgcagatacacgatgatgatttataatttgactactatcttccaatgaacaacaaaattataaggtatgcaatattttttcttaaatctgattgataaattctccaattattttccaatttataaagtatgaagaaagacattttccaattattatttgtcaaattttataattcacttacatgttaatgacatacacgaaaatgtacaaatcttctatgtatacaactacatatacaaaatatacaattatgtatccaaacgtacataccaactatagacatatattttttatgctacaaaccgaggaaactacatatactaaacaaaatatggtttgaccagactaaatatatttagttggtaccaataatacatgataaacaactacatgtttaaagataatgaaaatatagtagagtttctgtggaatacacagaactgagatttgatgattgattaaaccaaagataccgtgcgtagcacgggtactgacctagttccatattataaccaacatatttccatagtaaaattctaatctataaccaatcagatctttcaatcgaatcataaaacttgtttcaggaaaaagctattgtatcagcaataaaatcttcaatttaaaccttagcaatacaagaaaaagcaagttgtcaaattcttttgttgttacacttgaatataagatatcttatttaaaaattatgtaatttttttttgttctaaatcttttggacacttgaataacaaaacaaattcaaaatgaccaaatagcagaataataagagaggaaaatcacaagaatctaatccagcaagcttactatgtacctagcggacactttctctattgatgccggaaccaccacctcttcgtcattgccttatctgaatcgaaaaaactacaaaaaaataagctgatattgctcattgagtatgctacacttacaaaatcaaattcaaatcaaattatatgtttatctcgagaaaatgataatttagagtttttatcgttcaatgtatttatagttatctttttatatttttaaaattaataaaaaaggtttttttgttttacacatgtcaatatatgattttagtttctcaaaatttgccattaacataattatggtacattttgatttatttcctatattatcatattatcccatatattaaaaaatcaaaatttctttatttaatgaaagaatatttttttctcataaaactaatttgcatgtatttttttaaagactttttttaatatatacttagttacattttatatatcgaaaagtttttttaaaatcttaacctataagaaaaactaacaaatgtctaaaatatgatattaatggttattattttgttaaaaataatataatcaatactaaaataaaaataaaatattattgttatagttttaaagtgtaagatatcgtgcaacctcttttcacaaatagaatgtataatttcaagtaacacataaatagaatgaaacaaaattggttcatgcatggagtctagttctattttccaccacctccaagtaattttgaatttgaaaattttgtttttattttgtttttaactagaaaaatttgttttaaactagtagctgaatcattgagaaaaaaatgctaaaaccctattgaggtaggttctctatcttctctctcttcaatttttcagagcgaggccgactaacttattttcgtctgaattttttccgattatcaaatcctatttagggggctctcttccaacatgcactagatcctttgtagtatttcgttgacttttatctgatatcaatttgaccttcaaagtcaagatgactggcgtggccatcggcaatgccgctttgctctcggttgttcatgactcaataaagtttatgtcgtggtggtcattgatgtggtcaagccatagacttttgaaatcaaatttgatccctagctcttaagcttcttcaaatccgtcaaattactttctcttgccttcaaccgattgatcccaatccctaatctctgagatgggagatgttgtggttaggcggctccttcaccttcttcaaacaagaattcacaaactggtcaagatctaaaaggtctactttcgcttatccggttttctgtccagtgaatctcaacttaacggtgtcaacatatatttgatggttccaaagcttcatcagcgaagcctcatcaagctgggttttcaattaggtgctttaatttcttaagtctgtttaacaacaagagaaggcaagtagttctgagttttccggtggttgtggcatttttcgtcatcaacagcaaaatttagttcttggaaaagaagtaattgtctttcagatgcttctcaaaagaattaactagatattaaatattagattttgtttgtttgattgtggttttgtgcctataatttgtttatgttattgtacttttggtttgtgttttagcttcagggaattcttgtactaaggcaaacataaaatcaccattcgtactatttatctatgacatctcttatatatgtgaaactagtgtatttaaacaagcattccatgtacttcacattttaaaagaatcaaatatatttttagaaagaaatttgcgtaaggcgttgatgactctactcacctcacatgatctttatgtggtgttatcgaacatgtctagatgcaatgtgtatccatgggcaaaactatagatttaaatgctttacatggatatgatgaacaattgagagtggaactagagaaactctttgatctcaacagtgaattacaaatcccacaatcaatagaaaattgtcttcaaagacaatgaaggagatatgatgcttgttggggtgatccatggttttataattcctctttatttctatatattgaaaatatgtgaaggcattaaaagaaaatgtttgaagttgagggttgtgctaatgtagttaattttgcaacatggcgaataaaatagtcatatgatcaaaggaggaagtgtagaaaatgaaatttggaaactcggagacagagattagaaagcgacatgccacatgcaagatcatggtgtgttaaacacactacggttaataatacagggagatacaaatagtcactatcaagagatcatgtgacattgaaaagaattcattagtctcaaggatcgctgacacgaaccatgaaaagtagttatgagtatgcaacagattcttaccttacgagtaggaatccatggatagcttggtaaaagacttctctccataatagaggagagtggcgaaagtttctccaagtagtagcattgttgtaacaacagtttcttgtatcaaaagtaaatatgattattttgaccctcaaggtcaggtcaaataggtattgcgatgttgtgttaagttgtagcttggacttcctcaggaagatgatttgagggagttggatttgtaactgagaagagaaggcgactaaaaacatggttaacatgggatcacagaatgtacaagccaaaatataaacatttaagccgagaatattggtcccatcctaaacgaaaggagcttggggcagttgaactgatatccttcgtgctaaagagttcttcaaacaaaagccaagatgagcttgcaaacaggaaccgagataagaaagattcaataccaaactagactcaatgatttaaggatatagtgatgtcataagtcaatcaacatatggaatagagaaatccaatcaaataattaagaatacaaaggaactaaatcggagatgtgcaaagtaatcggagagagtgatggggcacaaaaaaaaagagaaagctttctttgaggaacagaaaggccatagttctacagatgagaatgtggatcaaactcattaaggaccatctctagagagattagggtttcgtcgagccaactagtgatctactcattacaaaacttggccaaaacctaaataatgggccacaactggggaacatgccagctcactaaaaacttggcttctttttgtaagtgtgaatggtggtcgttgcttggcggttgcactgtaacaaatcaaaggtcctagatggtttcatcgatgctggaaaggaaggcagttttggggttttaaaaccctcagaaagagggacgaaggagatgaaaataaggatcacatattgaaacatgcagtagctctctagacagatttggtggtaacagctttgcgaggagggatgtgaacagagggaggaaagagagaggagtcactgggtatcttctttgtcttctataactgttgtttgagctttgtttgaagctttccaggagaacaaaatattgaaatgattgagatatggaccaaaacgagactaaaggggtaatacaattacaaaagttgtgagcaagaagagacaaattcttatgttggcgagccaaagcttcattgggttcagaaatcaaggctagggtagctttctcaatataagagcatgggagcggtttctattttttcctaaaatctcaattattatcttaaatttgttgttatttggacaaaaattagagttaaattaccatcattttaatgaccaaatttgttatttcgttcgaatattttactaattgattgttagcgattatgatgaataaacgataaatttaattatttgaaaataatatgtcctatttacctggaatgtagatttatttaaatcaatctacgacaaattgatttttgttgttatattgatgtaaaccccatttatgacgaattaacaacaaactggatcgttattatccatgtatttcttgtagtccagaaagaaagataattcaatccaaattttgaagcaaagttttatttaaaaacagaccgaaatttgtcggttaagcagggaagatataagcattgtaagataaccatgtaggttgattggtcaatgcattatccagtatcttctttgcctcatatttctccatattaattgtttttgctcttatagtttcctttttgatgatttccgctgtatgaggtataaaaatattgatgaagaaacaaacaaaacaatactataacacatcaaaagctgattaacgaatttccaaatattacttaaactcttgacttgaaacagattttgagaaagtttttttatccaaattaaaaacctcaaagatttatttcctaatcagataacaatttaaaattttctgaaaacatattttgaatagaggatatcaaaaaatttcaatgaagaaaataattataaatcaacataaataaatatttgaatagatggattgacagcaaaagtttgttaagatctaaagatattgttcctccaaattatatgcttgcataagaaataatctatcaaaagttagaaaaatacatagcatatctaaaaaattgtagtaatacattgatgatttagaaacgaaaagttgttgcaaaaactgatctaaagagtttttaggcacaaaaactcattacatattaaaaacaaattataatttgatggacaaaatttgttaaaatacaagaaacttgaaaaattatgaaacaaatttgggttttaaaaacaattttatttatattctaaaaaattgatgcatttcaaattgaatatagttgtgaaccaaaagaattcaagatacatatatgtaaaaaagcaatattataccaattcgtgcaacaaaacaaggattaattaattagatggtttcacgccataattcgttaaaaacaaatctccaacagacagtttacccatgaaaaaaccgttggaaaacttataaaacatttcaggataaagtaattaagaaatttacaatgaattaaacatgcatgatctgtttctgctgccccaaaatatattatatactaataaatttaaaaatggtcaaggtaacataatggcaagttggtcaaagtaaaatgatctaatatccatattatcttggataattaataatatagagatttagaagattttggttgagatttaaaattatgtcttttctataattattgtttacttatcttttaaaaacgattgtataccatgcaaacctttttaaaaatctcttgtaaatcattctttgacacttacttatgctttaaaaacgattgtaaatcatgttaaccccttttaaaatcccttgtaaatcattcaaagccacttacttatgctttaaaacgattgtaaaccaaacaaacacttttaaaatctcttgtaaatcattctatgccacttacttatctttaaaaacgattgtaaatcatgttttacccttttataagcttttaaaatcccttgtaaatcattccaataccacttacttacacttaaagaaacattgtaaaccatgctaaccctttttaaaaatccttgtaaatcattctatgccacttacttatgctttaaaaacgatgataaatcatgttttacccttttataagctttgaaaatcccttgtaaatcattcaaagccacttacttatgctaaaaaacgattgtaaaccatgttaaccctttttaaatcccttgtaaatcattctatgccacttacttatgctttaaaacgattgtaaattatgttttacacttttataagcttttaaaatctcttgtaaatcattcaatgtcacttacttatgcaaatctcccttaatctaaagcgtaaatgtataaatatacttgattaaaattcgttcacaaatcaaaaccaaaaccaaaaccaaagcctttaaaaggtttatgtaaattatttttcactctttactaaggaaaacccccaaaaatatgatgtttaactaaaccaaaaatcgcattaaccttaaacatattagggaaatttgcaaaactaccctttttttactacccttttgcaacaatacccttttatattgttcatttttaaaaatatcgctttctttgaacagaatgaccaaattaccctcatctaataagaacatgtaattggaaactgaatgttttccgccaattttttggcgccaaaatttatttttcccgccaaaaaagaatttccgccaaactttttttcccgccaaaaaaaaatttcccgccaaaaaaaaaatttcccgccaaacttttttctcgtaagttattttttccagccaaaaaaattgttttaaaaaaccttgtaaattttttaaaaactcttttaaaaaaccttgtaaagttttttaaaaactcttttaaaaaaccttgtaaagttttttaaaagctttggtagttgctaaaaacctttgtaaatcattttaaaacttcttaaaatctttataaagtctttaaaaacataggtaaatactttgaaacccctttttaaacttttgtaaatcattttaaaactttttacaatagttttacaagatttacaatcgttttttaagcataagtaagtggcattgaattatttacaagagattttaaagcttataaaagggtaaaacatgatttacaatcgttttaaagcataagtaagtggcataaaatgatttacaagggatttaaaaagggttaacatggtttacaatcgttttttagcataagtaagtgacattgaatgatttacaagggattttaaaagcttataaaagggtaaaacatgatttacaatcgtttttaaagcataagtaagtggcataaaatgatttacaagaatttttaaaaagcgttagcatggtttacaatgtttctttaagtataagtaagtggtattggaatgatttacaagggattttaaaagcttataaaagggtaaaacatgatttacaatcgtttttaaagcataaataagtggcatagaatgatttacaagagattttaaaagtgtttgtatggtttacaatcgtttttaagcataagtaagtggctttgaatgatttacaagggattttaaaaggggttaacatgatttataatcgtttttaaagaataagtaagtgtcaagaatgatttacaagggatttttaaaaaggtttgcatggtctacaatcgtttttaaaagataagtaagtggtatagaatgatttacaaggattttaaaagcttataaaagggtaaaacatgatttacaagagtttttaaagagttttaaaaggatttacaaggattttaaacctttgtaaatccttttaaaactcttataaagtctttacaagcattttttaactcttagaaaaagaattgtaagtatttaaaacatttacaactcttttaaaactattttaaaactgttgtaaacctttacaaaaggttttaaaaagatttacatgagtttttaaagggtgtaaatctttaaaaactcttgtaagtcttttaaagccctttaaaataccttggaaatcttttaaaacccttttaaaatcgcttgtaaatcttttaaaacccttttaaaatctcttgaaaatcttttaaacccttttaaaatctcttgtaactcttttaaaatatttttaaacccttttaaaatcccttgtaaatctatttcccgctaaaaaaaattttttttacgggaaaaatgttttcgaattttttttttgcgggattttttttttctaaattctttggcgggcaatttttttccgaaattttttggcgggaaaaatgtttttgaaattttttttggcgggaaattgtttttcgaaattttttggcgggaaattttattttgaaatattttaggcgaaaaatattaatattttattttgttaacctaaatcaatttacaaatatgggtaaaatggtcattaaaaaattaaataggatataaataaaaatggtaaacagaaaagggtagaattgaaaaggggtagtgtgaaaaggacattagaaagaatttttcaacatattatccattttcatccaacaaaaatatataaataaaacaaaagattaaaattttaaattttgaattgattttctatatgattcggatagattagatcaatttaattattatctatatatagagagacaaaaagaaaatgtgtttacaaacttacataaatatcttgcttgcacataatcaacacaataaacacactacaagtctttcatgtgctaatacctcaactttttcagttaaccataacttgacacctctgtaaaatgaatagtcaatcagaacatttcgattaatacacctcatttacattgaccaataagaacttattatttttccatgtcatcccatcaactaaactaaaattagacattggcctagcccaaccaaactacttccaaaactaaaatctatataaaaacatgggcctaaacttctttatttagaaaatttaaacctaggcaaataaactaaaccgaatgtacaaaaccaaaactgaaacaacctgacccgttttatttttaaacataaataaatatttccataaatatttaattaaaccaaccaataaaacaataattaaaccgtaagtcaaaaatactattttatgaataaataaataattcaaccaacaaaaccaagaatgactaacaatcctaacacaatactaaccggttctaataaccaaaacacaaaaataaaccaaacgagttcctagatcatcctctcttccttgccatgatttcacgatcacactttatctttacctgcatcaacaatacaatgagatgcgtaagtattatcacaaatacttagtgaggcgatcctcccatctacgagctatacacacaagcaattaaaaaagtataatcacaaatacatcataaacaaacctgtcattgaacgattcaccaaaaacacattcaccacacctacataccatcacacaaaacaaaacatacaacccaatcgctcagataagctcatggtcatgcactcaccttaacaaattgattctaacaataattaaacccagaagagactctctttgcgtctgaaacagtgcagaaacgtcatacaacaagtcacaaccaaaagcaaccttgaaacaaactggacatgaaaaacagaaactaccagtctcaaagacgaaaccctaaaatacaaactaaccgttaactattaaatcactctggtaaaactctagccctagacgtcacaaagcttcccacaaaaacgcgtgccaatcggaaaccagatgagactacaatcgcagttgcaatccccgctggtcctaattcgcgtctgagaaaacgggtctcaagaaactgcgaataactccaccaattttaattcaaaactaattttgtaaactggagaataacgataaaagacttgggaataaccctactaaatgtcgttacctttgaccacgatttgatatgtcgaaaccgtttccttccaaaccctaacgattctagttcttctccttctttctctttttctcctttataaaacgaaaagtggctaactaaagccctaattttgagtttccttctcatataggcacactcttcggtttccaattaacccaaccgattagaccggacgatttaaatacaaaccctaaccgattttccggttcacgggcgttacaattctcccccactaaaatagattcgtcctcgaatctagcttcacccttccactccgagtaactccgtgcaaccatcactacggtccgcactccctccaaccagaccccctctaggtctctctatctaatcgatatactcaagatttactagtcattgttgctcacaactcactctccactctcagaccgcaatcttcgagtatcaaccgtcactctcaggcctcggcctacggtatctcgggtatcatacgtattatcttccccactcaaagtcaaaccctgagttgtgtcggctcactctcagccaaaaagtcatcgagttacgacacttggagaaaataataccacaaaactcgctctcgggtcgtcaccctaaagcgtgctatcggattgtcacccgaagccaccgtacccctcgcactctaaagacatcaagtccctcgagttatcggtacctcaggagcatactccgctcttcacgagtcgttgggaccctcatgtccctcgagcaaacaatactaaacgcttccgagcatatctccaaactctctcatggattcgcgtaagacacctctatgcctcaccatccatcatatcccctcgagaacatccttatgaccaactcccgaccatctcgtaaacacacctctctcttaggttgtttactcaaactttccaaaaatagataagtcctttttgggaaactttccatttttggaaaccacacaacacattcttaaataagacagctcaagtcaaatctaagaaaaaaaatactcatcttataaatcatcgaacgtcatgatcgttacaactccaaacgaaaatacaaatgaaagagaaaataagaataacaactcaaaatctcaaaaactcaacaacactgaaactggaaacaaaggaaagacaaactcatgcagcaacctgcttctcgaaccatttcttgaaccttgccttcatcctcgcctctggctcccaagtcccctctgtcacaccatcgaagtcccacaggactttgatcaaaggaatcttcttcccctgaagttcctttatcctcctctcgagaaccctcactggtctcgcctccaaagtcatgttgggctgaagatcctctggaatcttagccaacacctcatcatccttgtgaagacacttcctcagcatcgacacatgaaagaccttgtgaaacgcacgcataacatcaggcaacactaacatgtatgccactggtcccaccctgtcaacaatcctgaatggacccatgtacctcggactcaacttagtctctgagatagacctgttcggacctcgcaacatggccatcttgagatacactctgtcccaacctcaaactcaaactctctcctcctcttgtcagcataactccgctgtcgatcatgagcttccttcatgttcagcttaagaacccggatcctttcggtggtctcctgaacataatctgcaccatatatgctcctttcccccacttgggtccagcataacggtgtcctgcatggcctcccatacaacgcctcgaaaggagccatcccaatactcgtttgatagctgttgttataagcaaactctaccagactcaagtgatccgcccaatgacctccccaatccaagacacacatccgcaacatatcctcaagtgttgaatagtcctctcagattgcccatctgtatgaggatgataagccgtgctcatctgcaccttagtgcccatctcagcctgaaaggatctccaaaatgcagaagtaaacttggaatccctgtctgacacaatactcacatgtactccatgcaacttcacgatctcgcccacattttgcttagccaacaccgccgttccatcggtttttctgatggccagaaaatgtgctgacttagtcagacggtccacgatcacccaaatagcatctttggttcgcgacacatgcaatccaaccacgaaatccattgtgataaaatcccacttccactcaggaatggataaactttgcaagaggccacccggcacctgatgctcagccttaattaactggcaaacatcgcattgtacgacccaattagctacatccctcttcatcctgacccactgatagtaccgcttgaggtctcagtacatcttagtcgctcctggatgaatggaaaacatgctcgcatgagcctcactcaagatctcccgtcgcaactcctcatccttaggcatacaacctcgcccatgcacaaggatagtcccattagctgcgaactgatactcagagccctctgccttagaagctgcaatcaacccctcatccttctcctgagccaaccgaaccctactcggaagatctgctcgatccacagcttccaatttcaatgactcccgtgctacagcacacaatcacaaagcaccaatctcactcaccaaggcctcaacactctgccttggagccgcactcacgcgcttatggctcaacgcatctgcaaccacattagccttaccaggatggtaggctatctccagatcataatcagccaccagctccatccatcgcctctgccttaggttcagctctggctgagtggagatatactttagactcttatgatccgtgaacacctgcactttcctgccataaagataagacctccaaatcttcaaggcaaagattacctcagccatctccaaatcatgagtaggatagttgccctcatgcttcctcaactgtcgcgatgcataggcaataaccttcccacgctacatcaaaacacaatccaaaccaactctcgaggcatcaatatacaccatgtaaggctctccatgctctggcaatgctaaccctggtgtactcgtcaacatctcctttacgctcacgaaaccctctttgcactccggtgaccacacaaaaggaacatccttccctgtcagcttagtcatcggctgtgccatactcgcaaaccccttgacgaacctcctgtaataccctgccaacccaagaaaactcctgatctcagtggcattcgtcggtctaggccagtctctgatagcctcaatcttctctggatccactgaaactccctctgcagaaacaatgtgaccccaaaaacccatctctatctgccagaacttgcacttgctcaacttagcgaacagcttttgttctcgaagcttctccatcactcttctaagatgtacctcatgcttctccggacttttagaatacggcagaatgtcatcaataaagatgatcacaaactcatccaaaaactcttggaacacgctgttcatcaacctcatgaacgctgcaggtgcattagtcaacccgaaaggcatcaccacgaactcaaaatgtccatatctcgtcctgaaagcagtcttgcgaacatctgcctccgctatcgggatctggtgataacccgacgtcaaatcgattttggagaaacaagtagcacccctcaactgatccaacaactcatcgatccttggcaaagggtacttgttcttcacagtgacccggttcaatccccggtagtcaatacatccattcccagaataacatcatacaactttacagggctgataatcaaatctgctggcatcgactcccctacaatctgaatatccacacccttcgctctcccagaagcgctagaaactgccctccagcaaccttgacggctccaaactgctcaccaggatccccacagatattgccgcacgaggcactctctagggtaatgaagcaatgcgatgctctagagtcaaacaacacatgggcctctccaccgcccactaataaggtccctacacaaatctcatgtgctaagaaccctaacattcggttgtaccgctggactcactgcaaccacctgcctctgaaggtcctcctctacctcagcaactgtctcaaccagtgccgccttcgtggcctactgcgacactctacaccgcaccctcaaatccggtcgaagtcccctcaagaacctcctcaatccggcctggtcatcctccatgccctaacccgcatataccaagagtcggttaaactcccgattatacttccgaaccgaccgttcaccctgtgtcagctcaagaaaacgcgcttcgatacggtcgaacgcctcctgcggaaagaacttggcattaaactcagccacgaaatctgcccaagccatatccgcctgcctcctcctgacattcacactctgccaccacaaatgtacatccccctctagaaaatatactatcatatccacctgatactccaccgggcatctgctcgaaccgaagttccgctcaacctacgactgccaactatcggcctcctcaggactagtaccaccagaaaaaaatatccggtgccaatatgtattactcaattataaaagaaatatatatgttctcacatcgactaaaatgtttacacaatggatgaaaatcatattataaataaaaccaattgaattcaaaatccgagtgcatatgaagcttaacttgacaagcatccaaattttaaaagtttttgttagtttagtttggttctttagtcaaatcgttaattatactagatataataaattttaaattcttaaaaagttaaaaatataattattgtaatatttttaaaaaatattacaagactcaggttgtatggtaaaatgagtttaattgacattaatacggtgtcataagatgaaaaataattattttattgttttgttaacaccaccgattttcaaatattagatatgtagaattaagctgattcacgtatggttgtgtaagaaattatatattgctctttttcataaccaaacatactttgtatcgtttttttttattaccaaccaatctaatatcagcttaaaccgtgtagtgagaaactatctttttatcacaaatactactatcatgtgtactttgatatttgtagaattatatattttaaatacattctttattagtagtaacatatataactgaatctaaatttgaataacagatatctctcacttgaatttgtttttcagcttgtaaagagacatagttttcagtattgaactcaacttgagctaggtgccacaaatgagcctctttttctgctagacataacacatataactgatctttctcgacattttcaaatatgttttcattacttgctttccaaatataccaaattatccatggatatgcgaatgaatcaaattctaaagggattcttgagaataagtgatccaaatttgcataaatagaatacgtgggaaaaatccctgggaccatagggatctttggttaagctagcaatggttgtttggtatgtaatgtttcatagtttttctttatttgttgaagaaaaacaaaatcctttattttattattttgaatgtgtgcaactaatcttctatctcatattttgatcaaattctaataaacaattagaattgttttaaactcttttaggacatataaatcccaaaaagttttcttttttcggtaaaggaaggcgacattgtcccctactatttattcgaacaaaataaaacaaaaactaatttcaaaaactacgtgaaaacagagttccacttgtgtcctttaatatcaccgagctaacactctctagacaacgatcaaaagaatgagggtctactgccaacgaaaaagcatagtttgctaactcatctgcaagacgattaactttcctatacatatgagtaactcggactatccaatcctttatgataaatcttaagaaattgattatataaaaaaaacatataaactaaggttgctgaattgttttaacctcttttaattaattattgaactgtcgatttgacctcctaaacaccctatctacagctctctttttttgttaagaagaaaggtataaaagaatatattctaaaagttcatgtaacgataatatataaagggttctggagtttggtgtgattaccaaaggaaatatatatatatatatatatatatatatatatatatatttatatgtacttaagaattaagatttaaaggagaaagaggaaataaatgaggatatatatacatgcaacaacgtcaacatcatttttaacaaaaaaaagcacaacgccaacatctagctaactctcctcttagtgtattactttcatgattcgtcagcagttttgtttttatctgattttcgtctatcaaaatgtaataaagttctaattgcaatatggatgattgcacagacattttagcttagccggcattccgtcatcctctcctcaaagatcataatgtttttggttttatgaatacgcatataatacaggaaagtcaaagaatcttcctaatctagccaaaaaatggagatgaacttacctgacagacgtggctttgtataggattgacatgtctcgaagcaactattgcgatacggagggaggtttctcacgagaacgggactacaaattctggggctggaccagaatcacccatggacacaagtatccgactatattttttccattttactaaagtatatgaattgaaccaattcatcattctgaattactctctatgtcacgatggtattctaaacttgaaagtgcatatttttcttgttatttctaaaataccaaaataataaatttaaaattaacctttcaatttttctgtagtttcaattttgatgtaagtggctattttataaatacatatatctatatatatttaagcaaaacataagatgaaaaataagcaaaaattaagcaaaacataagaagaaaaataagcaaaagttaagcaaacataacaaaaaaatgtaacttgactaaatgcaaagctttttaaccaaaagataaaactttgacacaatgactttaatgaaaacgtcttttttaaaacaatatctatagaacatattattttactttatttttggctcaacttctactattcataatccaaagttcttacataacctgttctaaatcacagaatgttttatgtattgttcacacaatttggtgtattcagtactattatgctaaactacatcttcaaaatgcatatcagagacgatcacattattcttttgtctaataagggttttggatttgttaaagtaaaatttaattgtgacaaacggaaaaccccacgtctaccaagtaatttttttctagaaagaccgccatcaaagaaaatgccatttggattacctttttagcatcatgattttggtgaaaaaatgtatttctatagaatcgtcatattaaactttgatagatttgcattaagttacagactacttttggtaagctacatcttctaaacttaagtaagctacattattctttgcgtctaattattattataaatgaaaataattttgtagatctatgatgttaaatccactgatcattccatgacaaatgaaatatttctttatttttcattgtatattttatagtttatagacatattgaaaaggggtagtgttgaaagagtattcatagcaattattctagaattttgggtagaaaatctttatttatttctaattaatttattttcttattcaatattattcaatattattcataattagatgggtttaaaactaattatactcttacattataggatttacaatatttattatatactaaaagattactaatccaataagataattacaatattttaatgaggctgttttagtacattaatgtattaaaaataattgtttaaaaatgaaaaaaaaaggatagggtatttttcaaatgaaaactcaacaacagggcatttttccaaatttactcttaaaaataactgtaacaaatttactctcaagttccttcagactaccaaaatgactcttgtgcctaatagagaaccaagtaattttttccgatctgctgccttctctatgatcgaaaacaagactattaattctccaactgttcatggtaactttcttatttagatttttcactaatatatagtctatttttttgaaaatattaatctttcatattatcgttttttttgtttgtagatgcttatggtattgtcgtgagagtggggaatataacaagaccggactttgtccctcaagcttcagaaaatcctatactttctcaatttctcgaatttgagattaaaaattcttggttagtattttccactatatagttcgtcatctatttggttatatatctgaatgcacaaacatagtaaatattgttatctttatagttggtttaattcatagaacttagatgttttggtgaaataatttgatattgttattaggggtaaatctctgatatgtgttgcaagcggatatacttgtgagttgtttatgcaattatggaggggacttggtctagaacttggttattactggaactttggtatgaatcctacaatctgtgtgctacgattttggaatgttttttttttttggtgatttacgattttggaatgttgatgattatgaaggtatatttaagactcattttatcttatctataatttatatagctacttcatataataaaaacattaatattttaggtcgtcaatgtctaatctcacataatggtgcttcaagaattacattcaatcaaagttatccagagattaacatggatcgcgtcaggtaagaacatatttacattatcccttaactgtttattattttttaaaaaattttggtcttggttatttttaatttttctattttcctactgtttcagaactcaattccttcaacgaatgcaaacacctgagctacatgaagttgtggacgagaactgaaaatgcaacaccagacccctatctatcgttttgtttaaaaacttatctacatatgttttaaagttgtacttttaaagactttgtttatgtttttattgactttcttatgattatatctgttaaactttaactttattataactccttttatttaatgcttactaaataactatataaacttagatcaaattataactgcttttagattggccaattattaggttattttgatttaaataatgttgatcttttattgattttaataaaatgtatttggattgcaaattttgattacaatgtaatctaaaatatgagttagatatctatattattaaacaaagaaaaataaaaaccaaaccttagagtttattagaagatttgtccaaagaaatatgtcgttaaaattaacatcgttagagaatcttctaagttgaaaacatttattatttcaactcttatatataagtgccataatagaattaaattatagattctgttgtaaacaatatatttccatatatattgtttcctaatttgtaatcacttccattattaaaaatattttaaaattttgttacttatttctctccattattattaacttttatggaaattttgttattatatgtctcaaacattataggatcctgtgattattagtaatttatccacgcagttaagacaattggtatttatataagaactccaattaataataacgatacaatatttatattatttcctaaaatataagactcgccaaatttttaattttcttaataattgagttattcaaaatatatttacagaatcttcaagattacgaagtgacttgaaacgtcatgactgttattactttttaaaaaagttgcgtctaaagcatgcctctacggtgtatttgtctcttatatatatatatatatcggtatcattagcatctcataaaacgaatacaaaaaaataactaagaaatttctgccaaaagatggaatcgtttcatcctctttcactgttgaaaccgtctattagaggatggtgtattcgtgggagagttgtgaggacattcttagtttcgttggttccatcttcaaaggttatgggtttgattctcgccgaggaacatgtaagtattgactgtcttgtaatgataattctaggtttgcatgttttagaattttgattaatatgtttgatccgtagggtatgactattgaagctactgttgggtataagatgtcggatcactataaagattttattaatgaaggagaatgggtaacgataacaaattttggagttgttgagaactcgggttctgtcagggcaacaactcatagcttcaaaattggattttttgttgacattgtcgtcagattaacaagtccgctacccgctattcctcactatcgtctagcatccttctcttcgattattgatgatgaaatcgataaatctgttttagtcggtgagatttttatgaatttgttgtgttccttattttatatcatgcatctaagtgttcattagttttgtcattttcaatatcatatatatttgactctgatttattttaattaatttatataattttttggagacttggtgggagcgatctatgatgttggagaattgattaacacaagacctaagcaaaataacgtcgatgatttgacgctaatattcaaaataagtgacaatgagtaagtttccttcatagtttaattcgaattatctaaattatactattctaataatatttttgattttatgtttagaaaccgtgttttggaatgtctagctactaagaaggaagctcttgactttgatcataactatcgtcgatatggtggtggagttattgtcgctgttcttggttggtggaagattgaccgttattttgatggtccaaagaacgtacgtgtttgcacagcaggcacgatatcaaccgtctttccggatcctgatattcccgagtctaacgagatccatgagatataagtttttatctatcatcaaatattcttacatttcgttattagtaattatataaacggaatatctatactattatttataattgcatgccacatttgtttgttttttaggctccgtgatgaaggtgcaaggaatggcggttgaacatctacttaaaatttttttttacatgtagcctattgaactcggtctattattatttttatttctgtatgaacaagtttccatttttatttctctacgaacaagtttacatatttcgaatttagattaccttctaaaacttgatatcttacaatatcgcatcgctattatttgatgattgatttaaccaaagataccgtgcgtagcacgggtactgacctagttcacatagtaaaaaaagaaaccaaactaagatttagtattcattttggaaattttttttgtaatgcccttttcatgatggccttttttaactctaccctttttttttagccatttttatttctatcctctttaaatttttaatgaccattttacctttatttgaaaatttttttatgttaacaaaatgaaatattaataactttcgcccaaatatttcaaaataaatttccggccaaaattttttgaaaaaatattttcgcgccaaatttttttttcaaaaatatttttcccgcaaaaaatacttgagtgtgtgaatccgtcttccacattttggcgccgtctgtggggagcggaggattcttgagtcgtcagatttcttccgtgtattacatacccgaagtaagccgcaatgtctggagaggatgctaccaacgcttcaatagccgaaaccctcaagaccatgcaacaaactatggccgatatggcgcagaagttttcaaacgtggaaaaaatcgtcgaaacactgtaaacaatccaggtatcacttagccaaaatgttagtaccattcagtctcgtgtccgttctttaaatgcaggaaattctactagagttcgaagaactatcttcggatccccaaattcccttccacgaaatgcaacaagcgatcaaacgaccctggatggtacaaacgcgaatagtcaaccggaagatggagaaacgcatcctgaagatgataaccagttcgatgatcagcacgagcaagaaaactttgaccagctcgaaaccatgagagaagtaagtcgggaactgaaagaaatgaggtcgaagttccatcaagttacaagttcggagccagacatcaaccgagttatccaggaggctaggcgaacaccgttcaccccacaaattgcaagtttgagaatcagagattctcaaaaactcaacttagaaccatataattgtttggaagacccgaaaggctatctcgcagcttttctaatagccgctgggcgagttgatctgaacgaagccgatgaagacgcagggtattgcaagcttttctctgaaaatctgtgtgggcaacccctgatgtggttcattcagttggagccaggatcgattagcaatttcaacgaactatcgaaagtatttttaaaacaatactctattttgatggataagagcattttggacaccaacctctgaaatctatctcaagggccgaatgagacacttcaggcttttatcaccaaattttaaaacgtgcttttaaaactcccaaggatctcacaatagtcggctctatcggctttgtgaaaaggattatggcatgattcgaggtttaaggaagatctaatacttcacaaacctgatactattcaagatgcattatttttagcgaacagttggatggaagtcgaagatgaaaaagagagtttcgcgaaaagaaataagcaagcaaaaccagcggtcacttttccacccaagaagttcgaacctcgggaaaatcagggaccaaggaagtttggttcgcaaccattcaataacaacgtcggaaagcagtttcaggggaaaggaaggtcaaatacttgtgtccgagatgaaagctcgtattgcgatatacatagagtcacaagacatctgaccaaagactgcagtgtccttaaaaggcatctcgcaaaattatgggccagtggagacctctcaaaattcaacatggagaacttcgtcaaacaatattatgaatcaagggataactcagaggctcaaaactctaaaagaccaagagcggctggcgaagaggaaccaagaacttcaaagggtaaaatcaatgtaattcttggaggatctaaactttgccgtgattccgtcagcgcaatcaagaaacatagacgcaatgttcatctgaaatcaagcttaagtgaagaagtagactttcaaggcacttcgatattattcgaagaaaaggagacacatcatctcgaaatacctcatgatgatgcacttgtaattacgttggatgtagccaacttcgaagtatcgaggatcctcattgataccggtagttcggtagatctaatttttcttagcactttggaaaggatggggataagcagggccgacgtggtaggaccgccatcccccttagtggcttttacaagcgaatcgacaatgtctctcaaaacaatcaagctaccagttttggctggaaagatctcgaagattgtggattttgtcgtttttgataaaccagcagcctacaacatcattcttggaactccattgatctaccaaatgaaagcgctcccctctacttatcaccaatgcctcaaattcccaactccgagcggagtggaaacaattcggggagatcaagaagcttcgagaacttgttatttagctagccaccgattaaaaattcaatagcaattaacgaagcccgcaaagaaaggaataatcccgagattccctagcggacagaaagtggatgatgtcgtggtcgaagtaattctggaagcagacaaaccggatcagaaagttcgaatcagagctaccttatcaggcgaagtgaaggaagccttagttgaattgttaaaaaggaacaagaagtcattgcttggtcggcagcagatatgcccggcatagatccaaatataatatgtcacgagttgaacgtggatccaagctttaaaccggtaaaacaaaaaagaagaaaactcggagtagagagagcaaaagcagtaaacgacgaagtggttaaaaagaagaatggaaaagatagagtgtgcatttattttacagatctcaacaaagcttgtctaaaagatagtttcccacttccacatatagatcgtcttgtggattcaaccgccggaaatgagttgcttttctttatggatgctttctcgggatataatcaaatcatgatgaatccggaagatcaggagaaaacctcatttatcacggataggggcatctattgttacaaagttatgccattcgggttgaagaacggaggagcaacttatcaacggctagttaacaagatgttcaacgaacatctcggaaaaacaatggaagtttacatcgatgatatgctagttaaatcgttgaaaaaagaagaccacgtaaaacatttagaagaatgtttcgcgattcttaaccaatatcaaatgaagttgaatccggcgaagtgtacatttggagtcccatccggggagtttctcggctacattgtcacaaaccggaggtagacgaaaagctctatctatatgtctcagtttcgaaccatgcggttagcggagtcttaatccgagaagaccggggagagcaaaaaccaatttactacataagtaaatccatgacagatcctgaaaccaggtatacgatgatggaaagcttgcacttgcagtagtaacttcagctcggaagcttcgaccatattttcaatcccatccaatcaaagtgttatcaaatcaaccacttcgaactattctccatagcccgaaccagtccggtagattggcgaaatgggcggtggaattaagtgagtatgatatagagtacaagagacgagtcgccatgaaagctcaagtccttgccgattttttaacagagttaccggtactcggaggacaggagcagccgccaaatcagacttggaagttgcatgttgatgggtcgtcatcaaaaaacggattcggggtgggaatcaaattagaatctcccacttcggaaatccttgagcagtcatttcgattgttatttgctgcatctaacaattaagcagagtacgaagcattgaatgctggacttaggttggcacaaggagttggggccgatgaggtggtcgcctactgtgactcacaactggttgttaaccagttcaatggtgactatgaagcaaaggactcacgaatggaagcatatcttgaggtggtcaaagacttggctaaaaactttaagaagttcgaactcatttgcataccacagggagaaaacactactgcagatgcactcgcagccatggcatcaacatctgatcccgaagtcaaaagaatcattccagtagagtgtatttcagaaaggagcattaaggacgaaaatgaggcattcgtcgtcacaaggtcccgagctgcagcccgagatcgcggcgaacctgttattgaaccgtacctaagccgactgtacaagaagatactgggctcgaagaaactatcgaaccaatagaagaaatcaccccggacaccacagccgaagctggaaccgaaccgtgggttgacgaagacatattagcgccaaatgagcatccgaacgagaagctcggatatttcacgaaatcgaccaaattccggctaaagattggggggctgattggagggagccaataaagcattatatcgttacaggcgagctcccaaagaatagatggcaagctaggaaaatgagaatcgttagcgcgaaattttgtctatcgaagaattctttgtatagacgaggtgaaagtgatccctacttactttgcatctttgggcccgaagtcgagatcgttatgagtgaagtacatgaaggtttgtgtggaagtcattcctcaggaaggactatgactttcaagattaagaggatgggatactactggcctactatgatcacggactgcgttaaatatgctcaacgatgcaaccgttgccaactccacgcgccactcatccaccaaccttcggagttattctctttgatctatgccccatacccattcatgagatggtcaatggatatcattggaccattacataggtcgacccgaggtgtacagtatctactggttctaactgactacttttcaagtgtacgtaaacattaaagaatcggcggtaaagacgttcatttggaagaatatcatatgcaggcatggcgtcccatacgagatagttactgacaacggaccacaatttatctcacacgagtttgaagcattttgttcggattgggggattaaggttagttattctactccgcggtatccacaagggaacggtcaggctgaagctgcaaacaagacaattctaagcaatcttaagaaacgtctaagttatttaaaagggggctggtatgacgaacttcaaccagttttatgggcatatcgcacaactcctaggcgctcgaccggagaaaccccgttttcattggtgtacgggatggaggcagttgtcccagccgagctcaatgtaccaggacttcgtcgaacagaagctcctctaaatgaagaagaaaattttgcgatgctcgacgactcgctggataccatcaacgagaagcgagatcaagccttaatccgaattcagaactatcaacatgcaacagctcggtactacaactcgaaagtcaaaatcagacctttctttgtgggcgattatgttttgaaacgtgtgttcgataacaagaaagaggaaggagcaggcaaacttggcaataattggaaaggtccttatattgttaccgaggtggtccggaatggtgtttacagattgaaagatttggaagacagaccagtccaacgtccttggaatgtggtgaacttgaagaaattttatgttttaaaaaaaaaagggacacacattttttgatcccgaaatgggtacataggcagctcggaaacgagttcagctattaataaaatttgttttattcatgttgaaaaagagttcgattatacgaatgaatggaaacaagaagttcgactatgcgaacatacaaagcgggaagcaaggataaatttgtttaaaaaagaaaaacaaagaaaagacgccgaaatcttagaaatacttcggattaggaaatccttctcgtcttgcagaacacttcgaccccttgactagggagatcaagaatgggcatcatacaatccgggatgcgggcaaattcagcaattccaagttcgatctaatctccggggtgagagttgagggtgtgtaactcccttgatatcacggtaaccctccgcagcattttgttgatcttctttcgaagtttcttcttttctgttgagcgttttttgtgttgagccgcgagggctttgataatggccatcgcgatatcttggtctctgctcgaaaggtccttggatctgggatctaaagttgcgaagtggggagcgccctctgtctggtacattcgggatgtccttgtcgatcatcccgatcctcgaaaagtctggcatggattccgagcatcggaggttgaaggccataattgcacaagaaaaataaacgatattgttagtgaggtatgaagaaaaacctagagaggtaatttataaggagggttcttagctttcaaagatgcgattccatttaaagccggagtgattcgcggaagcattcacgtcgtcttgttcgccctgcattcaaagagtatctccaaaacgaatatttgatgaatcaaggaaagcccaataagtaagtccatacgaaaaaaaaaaagtttaagtctcagggaacatttagggaaggggctcaggaacaggctccttcatcgccggttcagagttcgaggtggacgtctcgttcttagcatccacatcgggtttgttcttcacgcgcttccaggggttgctatcgtcctcttcgtcatcaccgtcctcactgtcagacaggatcacttggaccggagcgtttacaggaccagggacttggcctcgagcacgaaggtacatccggagcatgtgcgggatttttgccatgtagtcgaagttcctccactcccattgataagggtcgctctccatagccctcacctttctttcgatacgggcaattcgggcctcgagcgtttgcctcttgaggcccaaacgctgtctctcatcgcataagcggcgatgcttgtcaacgacctagaatacgaactggttaaatacgaatcaaatttgttctggaaaagagagatgggcgatttaccttatccataaaatcatacgcctcctttttgtctttcgaggggaagtggaagcaggcgtgcggaaagagaacgccggcgggctcaaagccttcgccggacagaaacaatggacttccgggatcgagggggcagacggtggaggctccttcgttttccattctaaaggtgtttaccaagtaaatttctgagatcatattttgagggagttgagagagtttctgctcttatttatagtgatttagggttttactagaaaccacaaagttaataattgtggcgtgtccgaatgggtttatccatttttggaaatcgaggaaaagacaattattgccttagaagcgtgacacttttcctgatttccaaggaaaaaatggcaaccgtcgcatttaagacaagtgggtcattaaataaaggaaaaataataaaggctcaaagcctagaaaataaatcgaactgactaaacccgagttggggaattcgcgtattcgagtccgcattttttaggaataggtctgatcaacttacgaatcccataacttgaccacatggttaacgaagatgctatttaaaaaatagactttgcaaatccatacttaaatttagcacaaatgaaaccctcttgggttcataatcttaaaaaaaggtttaaaagcctcctcaagcaaagtacttgtttagcctacttagacaggtaaaataattcgaaaaataataataaattttgagtttaagggacagtccccactaagtggacacagccattacaagttctcgggcacctcgagttcgggttaggctggctcaggatctgcggcaactgtctcagtatcacccggctcgccagtagtagactgctcgctaggaaccccggagtctgaaccatcatcgtccgcgatgaccactgtctccgagttcgtggatggaggaagttctggcggggtggctaccgcttccggaatcgtcgctggcacggtgggtgcttcgggttccacgggatcactaggacctgagacaattattttggatcagaaaaagtacaagagtaatttcctatggttaggtttcaaaagctttgaaatgtaccggcccaatgtaaaccagattcgctcaaaggaggcgattcggtgaagaattccttgaactgttgaggattgaacgacgaggaaggaagggcagctaaacgacttcgcttctcctccaggacggtcttcaactcattcctctcttgttcctcggagaagtcatcttcatgggtttggtccaaaaggaggagattgctctcgtactccttgatgtctgactccagctccgtcctagccttcttggtttgaatgaagacgattgctccttggatcaattccatcccgcgacctttcacttctttcctggcctttgatgctgacctccctaattcagcatcccgatagttggctaccgctttgtacttgagctgcaattcggacagctggttggacaagtcgtaggcactggattctgaaagtctatcccgagaagttgagagttctttcgatcttgtcatacctctggtattgatcctgcaactcgccattggacttcatgagttcgaaggagagattgtctagttgatcctctaggtttttgcctggtatcatgtgaagaacggaggtcggactcaagggaagaagatttgtctttccatgtcaaagcttctttttccctgtctagcaaaagtttctcgtagtactcaatcatgtcgttgagttcgttgattgcctgaaccaagtagcaaggaaagagagttagcatctaagtgaaggaataaagtttaaagaattattatgggtgaagagaactaacccgagatgagtgatgggcgtggagtaggaatcgctctcgaattgcaggacgccacctatcaaaggctggcaggatggtgtcttttcgagttttgaagcatcgaaagacatttccctctgtttccatcgctgtcagaataaagaaagggagcgttaagtcaataaattaaaacgataaggccggaagacatagtggaaggtaatttctaacccgtgagcgacttggtctgaggaaccagaacagccttagttccggcatctcggacctcagcttcttcccgccgggggtttgaactccgatcggccttttcacctcctgatccagacgaagtagatacggtgactggaggaggaggacccatagagcggggtggtggagatggccgaggagagcgatctgtttgggctctcgtcttatctcttttgggggaggagctgctgcgggttgatctgtccctctttttccgaatcagatcagcaagcggctcgctgcttagtccatttcgggaggcaggccgaggtgaatcacgacggggtgatcgttctctgcgggatgaccggccgctatggcttttgcggtgaggagtgagtctataggcaccggcagatcttgccccttcggcgctgccgtcatcaactagcaaggttctgctatattctttcttgtcgactgcggattggaggaatgatttgttcgtttcgcaagcctccacaatcgacttggatagcgtcttgcgtcaagctgcgatggcccgagcagaagtcccttgaggtaagggagggggcaatggcagttggagaagatgtccagggggctcatcctgagcttgtggttggcctctacgaatcggtcgagggtaaaggagttccagagggtatccccttcgatgacgatcttgaagaattcggcgaattcaacagacggtagggtcggtgcgatgaaagctgcgaattgaaaattaaaagttggtcagataagccaagaagtaaataagggtcatatgcatgacctaatatctagtaattgtaggggattccgagatcaatgcaataacataatttaggcgggaaataagagagtcatttggcgcaatctttgcctttagaacattaaagccttccgaactggagtgatactttgaaagacttggagggctaattgttggtgtcggatcgcgcaccatgggcttgggtccggccaaagattgttacacaagtaggagaggcccataatagagagggcccataagtgtcctcgaggtgagagtatgggcgagatgttgatttgcgaagtggatgcagcatcgaagtcagaactactcggattgaagaagccgaatgggccggaaggagaagttcagaaggcccggagtggattcaaattcaaacgtccaaatagttaattcaaagactaaaaacggatacatttaaggtagaatgattgtgagtaaatggggattaaatgtattctttggatataaattgggggtcaaagaccatgtaaggacacacgcattttttggtgcaaattagctatacacattttttttacaatactcatagttttctctataatcatctatctattttctagcatatttgtcctcaagaataatcattctcactaaataaataaatatttgagtgtgtgaatccgacttctacaagagaccaattccctcttcctcctctttgaaggagagacctttttcatcaatcctctcctttagggagaatgtttctaaaagctcagccctggtggcatcaagctttattgttgttcgccagccttcaatggcaaaagaactaccagcactctcttcattatttgaagaccaagagtcgacgatcgtattcaaaccgatcacttttgaaatcctctcgaaggagcttccggttatcatccatgatgttaatctactattttactgctttcatgttttccctttcctgtttgtttctatttcaaactttcgacaaatgagttctttggcaaagcttcatgctgttgtaatcgcaagttaacttaatataagttgtttgacaaaaaaaaaatagattatttcaatagatattacaattttatttcatttcacgatatttaattacagatgttatatactatatcagttgaacaaaaaagaattcacattttaacattaaaactagaacttttaattatcaataacattaataaaacacaaaacaatgatcattacacgtactttaaatttgatgaacattggaacttgatatcatagggctataaagattaatatcgaaaaggaacggaagcaggtaatttgaaacaatagaaagaattttgaaaataattactttgtatatctaaacaaaaaataaaacttagaaaatatcatatatctattctattacgtaaaaaaagttagaatatgttttattgtacaacatttttttttaatgaaactcatactaaaaatttactcttttacatgagcaaattgtaggaattatatggaggattattgtttcctctatagaaccacatctgacgcatcctgaatcacaatttatacctcttaacacttcaaaaaggcttgaattgaatcacatagatagaatcagaaaactaaatgatagtattttaaatcaattatttacaaaacaaaaatacatggtttagcatcaattataataattgatgtcgtaattaacttgtttggcatcaattctataaactgatacaatttttattagtttgtatcacttttacaaaattgattttaaaatataattttacatcaattacctaattgatgtttttaaattttttttttgacatcacttattaaaatgttgcaaagtttacattaataaaaactgatgcaaataaaaattatattaataatataaacagatttatggaaattagcttcacttattaaaactgacgtaactattttcgtctttggcatcaaatttttaaaaataatgttattttagtttagtttgcatcagttttttttcttttcttttttattttttttatttttttaatttttttttattttgcatcagttaatacaattgattctaaacaaacctagttcacatcaaagaaatcttcacgtcatcctcatctcttccccattattattttttttgaggtttttgatcaatctttgacccctccctaaaagctttacctaaaagagtatcttctgatattaatcaagctgatttatattcaactttgaatctcttggataatctttttcctgatattaatacgaatatgtctagtgaacacaaacctggatcgtgtgagcaacatgaggacactgatataccatcaacttcaagtggaaattgtggaaaaggagaaggttttgatgatttgtttgctgaatttatccaagagctatatccgggatgtagtaagttcacgaagttgtctttcatattgaagttgtaccatatcaaatgattgtgtgggattagtgacaagggtatatctatggtgcttgatatgctgaaagatgcatttacacatgccaaattgccatgttcattaaatgacatgaaaaaggttattcgaaaactaggcatgacttatgaatcaattcacgcatgtctaaatgattgcatgttatattaggatgcagatgcagagagagagagatttgcaaagtttgtaaagcctctcgatggaaaaataacatttttgcacagagtatgatttcaagatcagagaatgagaaaaagaaagatcctccaaaggttttgcgttattttcctctaaagccacgactgcaacgtttatttatgtcatcgaaaactgctacacacatgagatggcatacaactgctaataacaatgatagtaaacttcgacatccaagatggagaggcttggaagacatttgatcaaaaatttcccgaatttgcatccgatccaagaaatgtcagactaggattagcaactgatgtttcaacccatttggtactatgagtagtagttatagcatctggccagtgatattgtttccttacaactttccaccgtggatgtcaatgaatcacacatcaatgatactctctattgttatccctgggaaacacatgcctggtaatgatatcgatgtatatttgcagccactaatcaaagagttgacggagttatgggattatggaattaaaacgctagatgcttccacaaaacaaacatttaacatgcgagcagctatcatgtggacggttagtaattttcctggtcttgaaaatttatctggttggaatacgtatacaacgttagcttgtccaagctgctattatgatggcattggagaatgattacgacatagaaagaaaaactgttttattggtcatcgacgttttcttcctcgagatcatagctttcgtcaagacatgacacattttgacgaaaaagtagaaacaagatctccaccactcatattgacaggttctacaattattcatcaactagaacaagttaatgttactcttggtaaaaaaatgaattagttggagttgggagaaaaagaaagcgacgtgatgcaagaagatgtggtaatcaacaatgggaatttacaatggcgcgacataatctggtttcatgcacatagagaaaaatgtgttcgacaatctaatctacacaatgttggatgacaaaaaaaaatcaaaagataatatgagtgctagaaaagatcttcgtgagctaggtatacgtcctaacttgtggcctgatgataatgagaaatatcaaactgcatgtttttctctgaacaatcaagcgaaagatacttttttaagtgtcttccagaatgtaaaactcacggatggttatgcttctaatttatcaagttgtgttgatgtcaatggtcaaaagctatcaggcttaaaaagccaagattgtcatgtgataatgagagatctattttctgttgcgattcgaaatctattgccaacagacgtgacttcagcaattgttgagcttttcggttttttagagatatatctacaaaggtgcttgataccgatgagttagataaattacaatacaatattgtagtgattttatgtcgtatggagatgtattttcctccatcatttttcacagtgatggtacatttagtagtacatctcgcagaagaggcaaaatacggagggttggttccattcctatggatgtattcgattgagaggtgagtattttccattttatctttatatatatgaaactaaaacttactagattcaattatatacacaggatgctaggacacttcaaatcatatgttgggaatcgcgctaagccggaaggttctatatgtgagtaatatttagctgatgagtgtgtaacattttgctcaatgtatctcaatgatatagagacacgatttactcggattggccgcgttgatgatcgacctctagctgagactagtgataaggttcaaatgacctagaactactctctcaaataagagatcaactgcagtattttaggatcgaattcacagagttcttttgttcaaacaatgagttaaatgtcgagattaacaccgtcgatccagatccagtgtcgatcgacactagaggggtatcggtcgacaccgtcgtattgagtcgtctctgagaaaagggtcccgtatggtgtcgatcgacactggagggtgtcggtcgacaccatctctgcaactgcgagctcaactcgtcttcagtgtccaattcctcccacacatcatctcatactctgatcaagatggcattacaactcttccttgggttagcatccggattaccaggaagaaaaccctcttgtctcttgatagattgtgcagtttgagctacctgtacaactagcttcttcaagtgagagctcaaattctcgatcttcccattaagatctgtgtagacagcatcaaacttgccattaaactctacaacaagctttgtttggctctccagaatctgctcaagcatcgattccattcttgtctcttctaagggtggacggggggcttggtaagttgaattaccataattcctctgaaagttgctttgaggaaaggtcttctggaaagcaggctttgaagtgtagttggaggaaccctggttccctgtaaacatgttgccactgaagttgccttgtggctgcccaaactttctgtatccctgaccatctatgtagaagactccttcttctgactcaggctcaggctcaataatctcttcctcagctgcaaagtggacatgcttcttccctgtgagcaagttatgaactgaatctatcttagcgttcacctctgccatctgatttcctgaaatagctccggcaatcttcttcctctcaaaatcagcattcttggtactttgctgcaagcgaggttctctatcagggctgtagcatcagctgggtaacgtgtgttgaaattaccattgctcgctgcatctagagccatctggtatctccaatcaactcctctaaagaaggtacctagaagttgtacctcactgaaaccatgatgtggacaatctcgttggtactccttgaaacaaacccaaacagccttgaaagcttcagctggaccttgtgtgaaggtagacagcttgtttctcaactcctcagacttagcatcatcgtagaaattgtttaggaaggctatcttgatgcttctccaagtcttgagggaacctgctttaagttgctttagccaagaagctgcttccccagcaagtgaataagggaagagcttgcacagtaggtagtcctctgagactccattagccttgatgctcaaaataagatcctcaaatcgctcgatatgatccattggctgctcacgagataagccatggaaaagatggtggccaactaaagcaaagtagccaggcttcagctcatagtcgttcctctggaatggtgggggtacaatcgctgatcaattagcatagaacaggtctggcctgttgaaatctccaagagtacgacgtagttccgcagctggaggaatagctgcaggaatctggtgttggtgtcgatcgacacctctgttgtgtcgttcgacaccgattgcatccgcatgctgctcccgatggtgtcgatcgacaccaagccctgctgcgtctctagcagctaattgcgcattaaggtgcgcctgatcctcattggcgtcctcaggtaggatgagtccatgatcatccaatatctgaccagaatcattgtaggcttgcccatcctcatctctcaaaactccttctgcatcagctctgatgactctgtcagccattgctaatttctgagtttttcggttggtgcgttcaagttttcccaaatccagaacagacaagttgataagcgccttctgttttgtgctccttgtttgcctaggcatacacttgaaacacagaaaagaagaaaacaagaaacgcgtgagtaacaaaatagaagtaaaaactagacgaaatctctaaacaaaactcaatgatgattcccaagaactttggcaacggcgccaaatttgataaggttcaaattacctagaactactctctcaaataagagatcaattgcagtattttaggatcgaattcacggagttcttttgttcaaacaatgagttaaatgtcgagattaagctagcagggtgatagtgaaaataaaagagaacaaagtaaaaagacaacagattgattgtgttgtaaacgatttaataaagagctaggaacagggtattctcaggaaactattggttagtagatctaatgaaagctaggttgttatcgaaccattcttaagctcgaactctaattatggaataaccggtgggcgtgccgtgaaaatccgtatatctatagctaataataatcggagaagccgagaaactatcaacctaaatatgcattcttaatgagttcaattattcatcttagtagataggccgattcttattacacacctataaaccagactcatcaaataatagatccaactgtaaatacctatggcgggcatatgtattgtctacattcaagatctagttaattactctacatctagcattaggcataattagagatgaagaattctacagatacctagcaaagtggactactcagacatattgaatgaagcaaacaacataattcagatagaaagcataaacacagtaaatagagaaggggaaagaagggatctcttcactgtattaaaaactggaatgaatctctcaagaacaatggatgaatagggttttgcaaaagtttgataaaagacttgataaaagaaacttaggtctaaaaataatatatagaccctaaaaatgtctagggactaataatgcaaatagggaagtcttcaggggcaaatttgattttctgaaacttgaaagcgtctaggtttttgctgggccgaaactggtgtcgatcgacaccaagagtgtgtcgatcgacactcctcgctgattcctgaaccaaaatcgtccttagcttccttttccttagcttttgctccaaaatgtctccttatctccattgttgtcccgctgcatagaatacctgaaaagacattaaaaagactcgagaaataacataaagactcaaaattctatacctaaaacatagataaaaatcagtgaaaatcgggttatatcaactagcataaacccaaattcagaactcttacttatgttcccaaaccttggaagagttgttggagcgggtaaagtttatactcttaatcatgtagagcggcaacaagcacatcgacatgtattggtcaactgccaactactagatcacctacgagagtaagttatctaattcaagaacaactaattatatttatgttttatcgaaattctctaatgtagacgttatggttgttgtatgtttagaaaatataaaaacgagttgttgaataaacaatctcatcaaagtagaaggaatcgtgttatcgatattgacagagatatgcatcttaattttgcaaaatggatcaagcagaaagttgagacgaatgagttagatgagctaactgatgatttacaatgcttagctcagggtccatttgaaaaagttgtaaagtatacagcttataatgtcaatggtttcaaattccggacaacaaaaagagaattagatctaaaaacacaatatagtggtgtgtatgtggctgctgagactacgagttatgctagttcttgtgattctaacccaagaacgagaactgtagcttactatgggaatctaatcgaagttatggagttaaacaactatgaagttttcaaagttgtattattcaagtgtaagtgggcggacactcatacaaaaagaggatataaaatagatgcatatggtcatcatatggttaattttttatgcttgttacacactggagataatgaagaggatgtaccatatatattggcgtttcaaacaaaaatggtatattacgtacaagatccttctgagactgattggaaaattgcatttcatattcagcctagagaaatatatgacatgggagattcagaacaactgaatgatgaatttggtactcataactccactaatgcttcctaagaagatatttataatgttaacatatgtcgctactggtaattgtttctccataatcatagtatttgttgatatgttggcattagtttgatggttgtcttattttctaggatttatctgcatattataagcttgttaaaataagggggcgagattatcatatatgattattctactaaaaagaaaccgcataacttatatatatttttattcactattttgttgcttatttatataaccagagacgtgacattttgcgtgaaaaaactgctgtgatggaggagaagttgtgtaatgctggacaagattcttttaagtatgacttttatttagcctatcatgctttggcaatattttgtttctttgttctaataagaattattcagaattattatgatcttcaacattttaaaactattatttattaattttctttttaaattgtttttctatatacacttgataaaccagttgtaggtaaattttggataatatttgtagctacaaccacattccggacaaagctaatatcatttggctcgataccggtcaactgtattggactaaatcaccatttacgcatccggtattgctcacatgtgttggagcaaaacgttttttgtgtcatccaaaataacatttgcatgtttcccaacggacgcacgtaacggcacgttgaattttttcacacgtccaacacatgcatgtaaaccggtttgaaccagtcttaaccaagaaaaccacaaaattgattttatttttttggttaaggcaagtgtaaaccggttataccatatcttaattaatcgattactttaattttttactcaaaaaaggcaaagaaatattattaacccaaatcgataattgcctttacattcttcatcttttttatcgtcgttttacgtttctctctacaaagaaacaaaaatctcttcacggttctagaactcaagaaaacaaacataggtgtggttgtgttgctctattctaattcaatctgaggtaagttctagaaacccaaatctcatggttaattttgaggtatttctatatgagctgtttatatttgacatggaaattgagatatgagctgaaacggaattagttcgtatcacatatatctccatgattattctttcaatttacataatttagctgcttttcttgatgctcacatttattttccctttggtatgaataaagttcttgagcccaaattgcttcacgttttgagccggagaagaatctgaaagctgacgattttgcacctccactgatagagaacatgaatcaaagagattgtgaaaggttttctgtatttctcaatcgtaacagaatgtacaatgaagtgtttatgtactctacactaaaccaaactaaaccatatacaatgtaattatatactaagttaaccggctaaaccgactatctatatacatactctaatagtccccctcaagcttgagcttcatatatgttgagaactccaagcttggtgttgttagctcgaaagagcgccagataaagaggtttagttagcatatccgcaagctgattatcagaacgaacaaacatggttttgagaatcccagcttcaatacattccctaaccttgtgacaatcacgctcaatatgcttcgttctttcatggaaaacagaattgcttgcaatgtgtaaagctgcttcattatcacaatataagtaagcaggagccttgaaaggaaccttaagagatgtcaacaagtaaccaatccaaagatgctccttagtagttaagggaagagtgaatacctttaaaattattgactactttagacatagttaagggaagagtgaatacctttaaaattattgattttagctaagcatatcagaaccactgtcttctcgtcatgctttacactttttaaagcactaaatactttctctgcaaacacaccccacaaagtacaagacaaaccctcattgctttaatacagtaacaaacgatttcaatattacttgtttgaaaacatagttattatgaatcaaaaattatatgaaaacaatgttctacttgccttgcatctcttatttgaatctctagttttttgtttggtttgttttgagccataatatcttctcacactcaccacttgacctaatatgtctgccattgtaaagaataccctgttaatattaaaatccgtaacagacatatagtttgagttaaactaatgatagggaatttagaaaatacgtaccaattagaacattttcatcataactctcggtcttaaccccttcaaaatatgctagatccagaaaaacactatccgatacaggatcacatttaatcacatctgtgttgtggttaaaagcccattcgatagctcaaactcgatatcttgtacttgccatacgaaggactcaaagtgaaggtatcaatgatcatccaatcaccaacctttagtgacatgttaaacttgccaatataatgctttctaatggtaatctgtatcttagatccctatatcaaaaccaaataaacaaaaacacataagaacatgttaaatgtttcaaacagaaatatatatagattcatatatttaatcaataacattctctcatacattttcatcacatataatgacatctaacgtcaatttgtttgcctccttagatgaaggatcttgacacggacacgccaattcgttttgaaaggcttgacatcactaagatacgttaaacctgaaggtaaactcattgattatgtgtatagatgagaaagaaaagtgatgctttagaattgatgatattgcttgagtatttatattgttaggacttgattctgaaaccctagttttaaagtatttatcaatactaaaataaaaataaaatattattgttatagttttaaagtgtaagatatcgtggaacctcttttcacaaatagaatgcatattttaaagtaacacataaatagaatgaaacaaaactggtttatgcatggagtctagttctattttccaccacctccgagtagttttgaaattgaaaattttgtttttattttgcttttaactagaaaattttgttttaaactagtagctgaatcattgagaaaaaatgttaaaaccctattgaggtgggttctctatcttctctctctcttgaatttttcagagtgagaccgactaacttattgtcgtctgaattttatccggttatcaaatcctgtttaatgggctctcttccaacatgcactagatcctttgtagtattttgttgacttttatgtgatatcgaattgactttcaaagtcacgatgactggcgtgaccaacggtaattcttgctgctttgctctcggttgttgatgactcaataaagtttatgtcattgatatgattctggtgaggaatcaatcccaattttggcacttggaagatctagagtgtatattctcaaaatagagacgacacacgactcaaagacgagatgatggattgaatgacgccacaaaaggatgcggaaagccttttgataagtcgagaaaagacatggggctcattaaggatggtgccctggacgtacacttgatatccatagaaataacatacatttcaatccaatccatttctcaaggaaacattagagtcatataactgaacaagtttatagtcacttcttaaaactcctatgaatcatttttaaacaagtaatttttaaataaattgtgttgattcaagttatttttcatcgttttctatcaaaaataaaacctcgtatatacatcgctaatttccgtcgactttacaataaatacatctaaagaagtatatttttcgttgattcaaacagtaatttaggatgatttaagttagaatatttctatcaccaatttacgacaaattaacgtagtattttatatttgtcaaatgccttgtaaatggacgtaagtttacgaaacaatttcatcttaaaatattgatggttaatctgtttttcttaagtgaaattaactttccaattttacgtagattggtttttcaagtctatatattgattaattatttaaaataactacatctaatgcagtgccatggcacaaaggagtgtggttttctcatgaaacaccgagatactccttttatgtatggttggcggttcacgacaagcttgctataggcgttaggatcctaagatggaatagggacacaacatgggtcttctatttctgcaaaagttgcatcgaatctagagatcgtttcttcttctcttgcacttttacttcggttatctgggacatgcttgctagaggtttgttcaagcgggagtatacaagtgattggtctcagctcatcaatacagtcttagccccgtgaagtaatcgagttgacaggttcctcatgcgatacttatttcaagccaccgtctataaagtttggagagaaagaaacagaaggcttcatgatgaaaaaccaaattctggagctatgcttattcaatagatccataaggaaatatgaaatcaattatccaccattcgaaggatgagaccgacgatacgacactagctatcaaggctggctctaaagtcaagcttaatcacaatacatctcaaataattcctgtttttcaatttgtttctatcaaacacacgaagcactagagtaataactttataattttctagctatagaggaataactatcagcaaaattgaatatatgtgtttatatttcatataaaaataaatcacaaaacatgtagcagaaaaaaaaaatcaaagccgcatagtagtaaactcgtttgaaactgaatcctaaaagtgtggttgaggttcaatacttatagattaatgtctaaaaaatacccgtcttttttgtgataagatattattaaaggctcaaatgagcaaatcttgggagaaattgtttacataagtgatatgtagcggttatgtacaaattttccgtaccaaataatccgccttgacctttgcattacgagagattaaagataaagaaaaataagagaattcttccgtgttgctttgaaactcctcaaaatatgttgaaaagactggccattcaattgggaaagacaccatcttccccaggtctgaacagtctgcaaaaagaattacttcttggttgtcggcattgatatgtccaggtttttactgatttctaacatagtttcagaatggttttagagtctttctagtctttttgtatgttttgagtcatttcaggtacacttacacatttgggaactatggagcacaataaggaattttggaagcttttcagcaatgaagatcttaaaagacgtttttcagaagttggtgtcgatcgacaccacacctgtgtcgatcgacactcttattgctgcctagggaattctcgttttctaccaagtttttgcgaagccctgaagtcttccttatttgcaaagtagtccctccacgtttttagtcacgaatatacctaattgtttggtcattgttagacctaagttttgttttagagattgttacacactttgagagaagaatccaatccttttagagaggattctgaactcccttacttgcattcttaaatcatcaatgcaaactatttagattatgactcagtaatcaccttgttgggtttagggagtctcaatagggatttagatggattagtagatcgaaaaccccttaggattatttttaaagttcttcatcttgattattcttattgctagttttagattgatcatctagaacttgatattagataataggtatgtccgccataggtacttgttattagaactatcataaatgagccgaggtatttaagaaagaacaggtagtctcatagaagggctctggtttagatactaggtgaacttatcaagcttattaacaatgcatgctttagcataggatttctagacttctttggttatctagctttaagtatagagagtttcgcggaacgccactggctactctagaatcatagtttgagttcgagaacggtgcgttaacaatcctaatattagctacatctacgatttatctatctcccgagaccattacttagacccgacgcttaaataacttgaatctacaactcgtttacttgcttatttgtcttttacattcaattacttcatctagcttattaaacaacatcataagtctattgtgtgaacatcgagagttcagtggaattcgacccttaagtgctaacgacgatctgttatttgaggaagtaagcttaaggcagtttaagctatatcaaatttggcgccgttgccgaagttctattttagttcaccattagactaggtgtcattttaagtctagatactacttttctaccacctattaacgtgtttctttgtcttttggtctcttgtgtttcaggtaccttcagattgagaatcacgttcccatggcagactttcacggttgtgtcgaccgacactattagggtgtcgatcgacaccctctacagaactagacggctacaataggcgatttagcagaactgacctcttctacacaaaccgatcagcattcaagctacctccgatgaatcaccattagatcatttggaagtcttaaaagacatcgtttcctctattaaagcagaaggtgtaccagctgattaccttctttgcaaactcttccccccactctctcgcgagcagaggaacatcatggttgcgtcaactggaaccaggttcattaaccaattggagtgatacaaagaatgcattcatgaatcacttcttcgttgaatccgtgacaaaggcaattcgtttacaaatctcttcgttcactcaggctccagtcgagtcccttagagcatcttggctctgtttcaggtcttatcagcgtgaatgtccccaacatggcttccaagagaggccaactcatcaacatattctacaaaggaacagacaagccaaaccggaatcaacttgatgcagcgagctactgtaacttcatgacaagaactactagtgaagcattacttctcatcaccaatgctttaacttgtctttcaacgcagggatttgacaaagaacgaagaatttcagctgagatagccaccgcgagcaaagagactctcgtttcaacaatttctgctcctatccaagccccccccccctccaccctcatcagagaccagaatggagtctatgcttgcgcaacttcttgcaggccaaacaaagcttgatagcaaatatgattctctctccatagatctcaatagcaagattgacactctacgctctcaggaacgaattccaaggaagctacttgatcatggaacttttgtacttagtttcaccatcaatcacgattctttcccaagagctttatgtgatctcggttctagtgtgaatctgatgcctcgttcagttgctatgcgtcttgggtattccaatcttgagcctacctttattactcttgtcttggcatatcgttctacccgaattccagatggaattcttattgatgttcccatgatgattggaaagagcatgattcctatacactttgtagtcttgccttatgagaaggaagctaaggatccattaatcctagggagatccttcttgcagacagctggagcaatcatagatgttcgacaagggaggatagggctgaatgttggcgatcttactatgcagttcgatatgaacactttggtcaagaaaccgatcatagaagggaaaaccttcttgatagattctttcacttcatcagctttagatagtatttcagagatggaatgagaagacccactagagcgagttttggtcttttccatagaagatagtgcagatttggacactgaaacttctacatatactaagctgctagatgagaccgaacatgtgatgcaacttacggttgaagaagctcttccatctatgactccaacgccgactactaattcagattgggatccagcaaaggctcctaaaatcgaattgaaaccatttccaacagggctaatgtacgcttttcttggtgaaaattctacttatcttcttattgtgaatgcttctcttattcctgcagagctcaccttattgctaagcaagctgcgcaatcatcgtaaagctcttggctattctcttgatgacattgcaggtatatctccagatgtatgcatgcataggatccaccttgaggatgagtctaagtcttcagttgaacatcagagaaggctgaatccgaatctgaaagaagtggtgaagaaggagattgtgaaactgttggaagcaggtattatctttccgatttcagatagtagttaggttagtctagttcatgtagttcccaagaaaggaggtgttacagtagtcaagaatgagaaagacgagctgattcctactcggacaatcacaggcccccggatgtgcatcgattatagaaagatgaatgctgctaccaggaaagaccattttcccttaccatttatcgatcagatgttagagatgttagcaaatcataaatactattgtttccttgatggatactcaagattctttcagatcccgattcatcgagatgaccaggagaaaacgactttcacttgctcttatggtacatttgcttatcggagaatgtcattcggtctttgtaatgctcctgcaacatttcagagaggtatgatgtctatcttcacagacatgattgaggatatcatggaagttttcatggatgatttttcagtttatggatcgtcatttgaggattgcttagcgaatctctacagagtgttagcaagatgtgaggagaaacatctagttttaaattgggagaaatgtcactttatggtgcaggatgggatagttctcggacacaggatttctgagcatggtatagaagttgatagagctaagattgaggttatgacaagtcttcaagcgcctgataatgttaaagtaataaggagtttccttggacatgctggtttctacaggagattcatcaaagacttcagcagaattgcaagaccattgactgctttactctgtaaagaagtcaaattcgagtttacacaagagtctcatgatgcctttcagtagataaaacaagccttgatcagcgcaccaattgttcagccaccagattgggatttaccttttgaggtaatgtgtgatgcgagtgattttgcagttggagctgttctaggaaagagaaaggataagaaacttcatgccatctactatgcaagtagaactcttgatgatgatcaaaggaattatgcaactgagttgttagctgttgtgtttgctttcgagaaattcagatcttatcttgttggatccaaggttattgttcacacaggtcatgctgccatgaaatatttgatgcaaaagaaggatgctaagccaagatttttgagatgtattttgcttcttgaggaatttgaatcgacaagaaattggtcaccaactgagaattgcgccgtcacagtagtcgagaaggattacccatggtatgctgatattgttaattacctagctgcagatgtggaaccgaataatttcacagattacaacaagaaaagattcctaagagagattaggcgatattattgggatgaaccttatctctataagcattgttctgatggagtttataggagatgcattgctgcaacagaggttcctgatatactatcgcattgtcacagctctagttatggttgtcattttgcaaccttcaagagaatatccaaagttcttcaagcaggcttttggtggcctagaatgtttcgggatgctcagaagttcatatcgcaatgtgacctttgtcagagaaagggaaagatcagcaagcgtaatgagatgcgtcagaaatttatcctcgaagtcgaagtcttcgattgttggggtatagatttcatgggacccttcccaccttccaactagaatctctacatcctactagttgtggattatgtctccaaatgggtagaagctatagctagtccgaagaacgattcagcgtttgtcatgaaactcttcaagtctatcatcttccctcgttttggagtgccacgcatagtcattagtggcagaggtaagcatttcattaaccatattcttgcaaaattgcttttacaaatatggagttcagcatcgggttactactctctaccatccacaaacgataggccaagttgaagtttcaaacaggcaaatcaaagagattcttgagaaaacagtgagtaaggcgaaaaaggagtggtcctacaagttagaagatgtactgtgggcttacaggacagctttcaaaactctgcttggaaccacaccttttcatcttctatatggtaaagcttgtcatcttccagtggaattagagcacaaagcagcttggacagtcaagatgatgaatttcgacatcaaatctgctggagaaaggagacttattcagttgaatgagcttgatgagatacgaactgtaacaacccgccccgtgagacccgcacacgtggccactctctgccacgtggcatcctgttggctctgcagcgcatctacccaaacatcgacacgaattcatgcttatgacaactcgaagctctacaaggaacgcacaaaagcttaccacgacaaaaagatcctcactcggacctttgagcctaatgacctacttttttatgattctaagttgacaatatttcctggaaaattatcttttcgttggtcaggtccctacacagtccacttggttaggccatctggaacagtcattctcaaaaacaacaatggaaaaccatttgccgtgaatggatagagagtcaaacattactgggctgaagccaaattccagtagaaaagccttcggatcttcaggacccatctgttgattaagcaactgtagagtcaagctattgcctataaacaagcgattagtgggaggcaacccactggtaagtatttctcctttttatttatttcattcatttgattcttaacttaggatttttgattttataggatttttattcagatttaaaaaaaaaaaaaaaaaaaaagaagaagaatagagtgttgaccaaaaacgcgatggtgtcaatcgacactagggtggtgtcgattgacaccctcattctctagatccttctcttctgcatgccgcaccacgtaccaagagttggattttcctcgtcggctcttccatatcagctgctttctcctccacccatcccgatggagccacatgtctttcagcagtacgtcgtcggcagtttcaagagcgtctagaatgccatagctaccctttctcgctgcggttgtgtttctcccactcgtcgtcgtcgtcgctctcccgcacccacctccggctcagagcatgaggactagccatcctccctatctttctttgttttctgactttgtttttgctttatttcagactattggttatttgttttgaaacttgttacacttatttttctatgctttgttggacctattgatgtgtgttttagtgatttaacagtctaaccggaggatccatgtgaaaacactaaccaaggctctataacaatgagctgaattcgcaaagctaagcaaaaggaccagagtgtcgatcaacaccaacatggtatcgatcgacaccactcttaggtaggaactcacgtttctctaacttttaacttttgattatttttccttcgatttctctagcttaataacactggggacagtgtcatataagtctgggggagtcagtaactaacttcatcttttcttttcttatgagtcagttgtgtcattttaacttagatagttgttttattgagtcaaattttttgtctgaaattatgatctatctctcgagtttattgcatggattgcttaagtactgcatattcaaatcaatccgactaatggaaaatccagaaagccaatcaataaaattaaggacatccattcccaacataatccacaaaggctggagctaatctcactactcttccttttacctcatcaaaacggttagtgttcataggacttgactccttgttcgtacctgataagtcgactaatgtgttaaaaagaaaatgttcatctcccaaaaaaaaaaaaataataataataataaaataaataatgagagattgagaagactttcagatagtgtataggggtaggaatgtttcctatgaccccattattataaaattatttggaacgataaattacaaaggttggaaaaatactgagggtgtcgatccaatatgcgagttcccctttgtttactctctaaaaagaataagtctgggggagagaaagaacaccaaagaaataaatatataacgaatggtcgatctatcatggtataatacaggaatgagtctagaaggttcttaagcatttacttgattgatgagacccagcgatgatagcctagtggatatagttgagtgctttggtatggaatctaggatgttgtgtgggctagcggagaattacttggtggtcaggatttgattagaactgttcaatacatggatttggtttgtatgatcaaggtaataaactagagagattgggagtttctatgttttccaaacctctttcacagattcaaccttttgtttgcttgagggcaagcaaaagctaagtccgggggagttgatatgtcctggtttttactgatttctaacatagtttcagaattgtttttagagtctttctagtctttttcgtatgttttgagttatttcatgtacacttacacatctgagacctatggagcacaataaggaattgtggaagcttttcagcaatgaagatcttaaaggacgtttttcagaagcgatcgacaccacacctgtgtcgatcgacactcttattgctgccaagggaattcttgttttctgccaagtctttacgaagccctgaagtcttccttatttgcaaagtagtccctccacgtttttagtcacgaatatacctaattgtttggtcattgttagacctaagttttgttttagagattgttacacattttgagagaagaatccaatccttttagagaggattctgaactccttactttcattcttaaatcatcaatgcaaactattcagattatgatttgtgtttctattatcatgtctaagtaatcaccttgttgggtttagagagtctcaatagggatttagatggattagtagatcgaaaaccccttaggattattcgtagtgttcttcatcttaattattcttattgttagttttagattgatcacctaaaacttgatattagataataggtatgcccgccataagtacttgttattagaactatcatagatgagcctagatatttaagaaagaacatgtaggttcatagaaggactatggtttagatactaggtgaacttatcaagctgataaacaatgcatgctttagcatatgatttttcggcttctctggttatctagctttaagtatagagagtttcgcggaacgccactggctactctagaatcatagtttgagtttgagaacggtgcgttaacaatcctaatattagctagatctacgatttatcaatctcccaagacaattccttagacccgacgctttaatcacttgaatctacaaatcgtttacttgcttatttatcttttacattcaattacttcatctagcttattaaacaacatcataagtctattgtgtgaacatcgagagctcagtggaattcgacccttaagtgctaacgacgatctcttatttgagggagtaagcttaaggcaatttgagctatatcaggcatcaatcatacgcttcattgcccaaagtaaagcttcgacttctgtatggaaaggagaaaacttctacgcagattagcaactcccatggttgacgcccctccatttaatcatgtgcaaagccaccctagacctgaaaagttttcgctttctttccatgaaccgtccacaaaggaaagaaagcatgagtatatattatcttgtgagatatctctcacccgaatttgttttttcgcttggaaagagaatttgttttcaatattgaactcaaattgagctaagtgccacgaatgagcctctttttctgctagacataacacatataactgatctttctccacattttcaaatattttttcattccttgctttccaaatataccaaagtatccatggatatgcgaatgaatcaaattctgaagagattcttgagaataagtgatccaaatttgcataaataggtgggaaaaatccctcggacaatagggatctttgaaagagcccatatgtgtctcgccggatgacactggaaaagagtatggtttattgtttcctctatagaaccacatctgacacatattgaatcacaatttatacctcttttctgcaaattctctgttacaggcacgcaacttgataatatttgccataaaaaaatgccgtaacttaggcggacattgcactttccacacatgtgctttcagagctttgatctctggacaaatgaaagatgaattaagatccttgttaactattcgtgttgtatggtagccggatataactgaataatttttggattttgtgaaatgtcaacctaggatatcctcccttgttgacgcacccaagtgcagtgcacttatcagctcgacatcttccggctcaaaaagctccttcaagagatcaatgttccaaaaataaagccgaattaaaatcatctacatccctaaaacctaagacaccttccgatttactactacacaatttattccaagccatccagtgcatacctctagattctccatttaaactccaccaaaatcttgcgacctcacttgttagtttaaaagtaattgttttcggaagcctaaagcaagacatcacataagttggtaatgccaaggctaccaatttaatcatcacttctttccctcctttcgataagaatttaaccgaccacccatttaatctagtctataatccatctctaacaaaggaaaaattctttgtcttagagccccctaaactctcaggtagcccaaaataggatcccatacctccgatattatgtatagccaaggttgattttatttctgcctttatagcttcgtctactttatgcctgctgaatcgatgatttcacaaaatttatcatttgtcccgaaaccgcttcatattgttttaggatacccaatattattccgcaacggtctttatcagctttacaaaagaaaagactatcatccgtaaataacaagtgagaaactgaaggaatcgatgttgctactttgatacttgtgatcaattttccttgttttgccttccggatgttcgctattagcacctctgtgcagagtatgaataagtaaggagaaagtggatctccttgtcttaattcccgttatggtattattagtcctttaggttgtccattaagaaggactctatactgaactgaagtaagacaccacattatccatgatatccattttacgcaaaatccctatttccttaataattccttaacgaaattccattcaaccctatcatacactttaatcatgtctgttttaattaccatgtatttttaaaagcaaattttttgtgtcccactttcttcaaccgttcgacgatagacgttttttgtttagctgagctagtgttatatattctttgtttgtattttgaacttgtatccacatgttttgtttgatggtagatattctaaaaattaaaagaaaaaaacttaaattagaggtaattaaatttaaagaacaaccaagagtgatatacgtataattcgtaaaaatatggtcttagttacgtaaacatatgaacaattatgtattgacaagactagtaatgtaaacatataaacacttaaaagaatatattgacaaagattggcctcttaataccgttatgacaaatagatatcaatataatgtatcatcttctagatattaaaatagaacatatgacctatagataagattgctttcccaaaaaatagctttaccaatagaacaaagttgaagcaatggtagtatttttgaaaaaaaaacatttttgtttcccaaaagattggcctatttgtttatatagaggttagtatttataatcatttttcttctaggattaataataagaatgtataatttccttaattatagtattttattaattgattgtataatttcataaatcccttctttattttaaaggcaaaagtattaatttcttttagaatagtaactttaaatttgaataagtaaatgattatatatttttatattttatataaaagaataatatctgaaaatataacagattggacatgtcagtaatcatcgttcctccagtttctttagtaacaaatccaacaaagtttgttgttgcaagcgtcatgcatatatatggtgaaattggacttggctcaatgtcttttggaatcttgcaattgtatggattcaccccagccgcatttacaataatgaagttaccatattaaaccaagagaatatattgtatatattccatatcttttttaattaagaaatatgaaattctatacacaatctaagagaatatgataactactattctatattataaccaacataattccatcataaaattctaagtttctaccctatcagcaatcaaatctttcaatagaatcataaaacttgtttcaggaaaaagctatcgtatcagcaattaaatcttcaatttaaacaatagccatacaagaaaaagcaagatgtcaaattcttctgttgttacacttgaatataagacatcttactttcaattatgtaaattattttttttgttctaaatttgttcgacacttgaataacaaaacaaattcaaaacaactaaagtttttaagaccatgtaagatcaaatgaccaaatagaagaataataagagaggaaaatcacaagaatctaatccagcaaacttaccatgtacctagcggacactctctctattgatgcaggaaccaccacctcttcgtcatcgcctaatctgaatcgaaaaagactgccagaaaatgagctcatattgctcattgagtatgctacacttacaaaatcaaattcaaatcaaattatatgtgtatctaaagaaaatgataatttagagtttgtatcgttcgatgtattaataattatctttttatatttttaaaattaataaaaaagttttttcttttacacatgtcaaaatatgagacacaatcctataattttttaactttaaaaaccaaacgttcatactttatataataaacctagattgataacccgtgcttcgcccgggtgttaaatgttgatatataaatacatgttgcggggatttttggaaactattgtactatgacattttaattgtattatcgtatttttttttttttttatcttatgattttgttatatttataataataaattattttaatatatatgtgttgacactcattatttttatatagaataatgttgtaacaaatggttgaaatgttagatttattaattatagtatttgagtatattttttttgatatgcatttatttattggaaggaattttatatatgaatttagtatagtattatatattataatctatgtttgtcaagtgttagagatattttgtttattacattttgttattttattaataatgaaaataagataattttattgtgaataattataatatgaaactgaatttattttttcctgtgtattataaatttcaattaagaactctttatgttcaaaacaaaatcacaaaataaaataaaaaatatgtgatttacaaatgtaaaagccttttattcttttaaattttctaaatcatcctactatattatttgggaagtacattttaaatgtaaccttaatttttgtaagtaattacatatatatgccattagaaataaaaatttaaagagtaaattaatttatctctttaaggattaaaaagtcaaatactaatttaattaattaaatttaattaaaaaacgaaatacattattaatttctaaaaattataaccaatcaaaataaaaatataagatttgatatctaaattttaattaatttaatttaattagaaaaacgaaatacattattaatttccaaaaaagtaaccaattaaatcaacaaattatatttgatatctaaattatcatattaattttttattaattattatagttcacttctcatctttatatgattctatttttgcagaaaaataatatcatcattataaaaaaataattagagttttttcgcatatgccatgatttgaatttttaaaaacaaatataaactgttcaatagatgaaaaatattataacgggtgaaaaatagatttaagaaaactttctactgagtaacgggtcataatttgaaatatttatattcaatttcatacatattatattggaaatttataatcttatatactacaataattaataacatattagatgtgattcaatttttaatacaagctggaaaatcctagaattgacgggtttaaatcgatattaatacaagatggtatactacatgtgaaattcttaaattaacaatcaaactacaagtgtataatcttaaacactaaacaatatagataatatcaacaaaacatatacaactcacaatttactatacatttaaaatcaaataaaataatatcatatatttttaaatcatctttacaataaaagtttttagtttaactaaaatataagcttacctgcggtatactgcaggttaatatctagattatagggcttactagatctaaagacgggtcatcaaagatttcctaaactgaagcaaaatatattgaatattcaaatatctatctgttttataaacaaataagtcaatttaatattttatatacgaaatcaattaaatcttaatcacataaaaattagcacaaaaaaaaagtattcaacaattaaaaaattatcaaatctttgtgttatataagttttgatactatattcgaataaagtgtaatataccttttcaatttgtattctttaactaatttaagctaactaatatatttgctaatcttatacttatcaaaaccgactatagtttcttatctctatagtatttttgcaagaagtttttggtggatttggatagggtcatatggtacattcccctattaaataaatatagtgcactcctatgttattagctaaaatgtttagaatataattcagagtcatatcattaataaaattaatattaataaaataaatggttttttggcaagacggatttggaggcacgggtttttgaatcaacattaataaaaaaagtaaaatataattaatctaccgtttcaatacgggttaaatctttaatttagtattttctaagaccactaatattaaatatatcaaatcatcctaatttagaaaagattatataaaaccaaaaatgttatgtgttatgtataatgttactatatataaaattcaacaataaaatataaatgtattagagaatgattcaatttgcaaagcttttatatataaaaaataaatcttaaattttaaaaattagtactttaaaaaaaacatcacgggacgggtaaagaaattacagaacgggttttattttggaattggattatatggtggatgtatttgaataaatatttataaaattttaaatattattaatatgttgttttaataaggattaaaacttcagttttttaacaattgtctcatggattcgtggtatagcgttacttaataacaattataagctgtaaaatataaatattttataaaaaataaaatttgcaagttttaatatatattacttttaaaaaataaatcgtcccgcggtataccgcgggttaaaatctagtctatacttaattaaagataacaaaaaaaaaacaacctatgtttaaggacactttgactaaccaataaaaaaacagtgtgatataacctatagctgttaaaaaaaatgctattcggaaaaaaaaattgtcgagcttaaattcatttttttgacattgagcttccttcaattcgattctaatgtcaaaagctttactgggtttttcggatgtcaacaaatattatcctaccatttcatcaattaatcacacaatttcaacagatctaatcgaattcgattgaaattttgataagtggagaaggcggaggataatggttttttaaagttagaatctggtgattggagtcttgatgtttggagttgtccgaattctgattcatcttccgctgatcacctttcgttatgttcaatgtgatattgagaaggtaaacaaactttaatgaaattgagaatcttgattgtttaatgaatcttgatatatatatatatatataagctttaatgtattttggcgaattgcatatatatatatatatatgcaattcgccaaaatacaataatgagaattgttctttcactgtagtacggaaacactgaagtttggaggccatcacaacggatgtttcattgttgcagtcatagaatcgttttgattcttcacaaacctctcagacaataacaatcctgaaaaggtacatggttcttaatctttaagcaagtaatatttctgcatttgtgtgatatggttgatatatagataatctaagtaacatcggttagaatctgtatatgatagtgtaaactcttagattgaagaagcaaatattcaacgaatattgtagatataagacggctgtaataaaaatccaacataagtaaaaaacaaatggaaactaaagattcttaaaaacttctttgaaaactacattttttgtttgcttttgtggcttaccttcatcatccacaatcagaatctttaatcttgtctttgatgtaactctggatatggcaacataaagttggttgtgtgaaaagcatggcctaggtagaaaaattcctactcttttcaaagattgaccctggcttttgttgatagtcattgcaaagcaaactgctaaaggtagttgtgttcttcgcattctaaatggtaattttgtgtttgatggtgctagcttcaatcttggaatcaatactcaatgaccagctctgtcatcggttagaatcattgcttgcaaaatgaatggacccatttgcgtgatctgtaactttgtgccattcattagaccacctacaggatcaatatttctgggcaacataagaggacaaccaatctttagacgaagcctatggttaggcaaccctgaaactttaacactattcaaaaagtcaggagtcaatgccggattattgttaccaccaatgtcatctgggtctacactgtctgaacttaggaatataaactcctctcctgaaaattaaaattttagttagttacagttaaagaaggaaaagaaaatagaaacactattcataaaagtaaataaagttacaaatcaatgcttctgaattagtaaatacattggaggttatcaagcatagttttggttgacatcttcgtttgtgggacataatattgctctttcttcgaaaaaactggatcattttgttcatgtatctttgtaatatctccatatatctttatgcatatggcttctattggatcttttgctttcgtaatcagaaattcagaacgaatatcgatcaaagcctccccatcattaggctcaacaattctaccatcacctactgctaaaatccactttgaaaactctttaatatcttcagcttcactatcactcaaaccttcagaataaagacgcatattctttgtcagagtcaatactttgcaatgacaccaaaggtaagatgaattaagggcatacataactatgtctaccctatcagcaccggggatttctggtagaacttgtcggaaatcacctccaaagacaacaaccttgtcaccaaaaagtttattatcaccattcccacaaatatctgacaaactccgatccaatgactcaaaacagtgtctgctcatcattggagcttcatcccatataatcagagaagcttctttgactaaattagtcctatctgaaccagctttcatattacatgtagtaaactcaataggattaagaggaattccaaatctagagtgagttgtcctaccaccttctaaaaggagagaagcaataccactggaagtagtgagtgttttccaaagaaatgttttatctgttcctccaaagccataaacaaaaaatactcccccaacattttcattcacggcaccattaatgtcgtcgtaaatagacttctgctctagagtaagcatcttaatccatttggcatgtttttctgtcaaattatcacgatcataccctctctcatctaaaatcaagacattagtatcaaatctcggatctctaggtacttgtggcatagtcttataatatgtaagtgaacgaccattccttcttaaaatgtgatctatctcttgtagagcatataattttttctcctcatccgacaaaattaaatctataaacaacatttaactaaatgagttacaaccaagcaaagcaagtttatgtgaatattgcattgtaaaacaaaatgagataaaattgaggttttgaaatgatattagatgttacctggtctgttgaaatattacctcttattgttttgaatatcttcagagagatgtggccacgttgcagcccacacattttcaggaattatcatagcatctaacattattacgaataactgacgtaaataccatccactgctccaaaaacttgttctctttaaatcatcaatgtattcatgatcattatctaataagccttatgcttcacaagcatctttccactcttcatatagcataccattaactgtcctgagctcttcaaaacatcttggacctgattgaacattgaggagtattctcaaataatattcatcttctatatcacgaggaacatagtttattcttcctatagcaaaacctttctttctgatattaaattttttttcttttgaatcataggtaaatctagtggggatgtctacataagttagcttcctagcaatcctactaactttatttaattcgaaccaacaaggaacatagagccatctagatcactacgatttaacactgtttctacttcttcatggcctttaaaataaataatttgttcccctggcaaatggaacgaaagcttcatcacagccgtagatctataatgtatatgatattttaatattctccaggatgcttcgcaagcagaaacatatctgaaattcaaaattatacaatcatatggaacacaaatatatgtattttatagtaataatactattaactttttaattaaacatacgtgcaattgaaatagtcttcgacttcattcttcttctttgtctctgatcaatctcgatcagcattgtccttctgtttaccctttcctttacttttcgaatttaaagacgatttaacaacaacagtaacacgatctggtattttatgaatatacatgaatatgtatttcacagaacctgattggttacaccattccacggtgatgtgagctatgtatctcagtgatagggatctattataaagaatgacatatcggttatcgcatttaaagtctttcttctcaacaaagttatttgttcttctctttctgtattttgcaaatccttctttatcaataatggtcttttgaacatgatctttcggataaaactttgaacactttcctttttccatactatggacatttcgggttcaccacacgacaaggaccaagaaccatagattcctttatcacttcaaatagctcaaagtctttcaatttgtcaggaatctctactgatataactttatcaatgtgctctgctttggtcaacttacactttgaatccagccaaattagtatatgagcatgagggagtcctcttttttgaaactctatggtatacatagctgcaattacacagaaaacataataattattatagttatcaaaaataataatagaaatcatataagagtaaatgaaacgaattaaaaacttcttacatgttcttgtctttccaaatagtttttttttagttaaatcaagcattagagaatcaagtttcattttgaagattttgcatataatcccaggtctatcatcagctctcaagtttcgctcaccacaaaacctaatcacctctggccactttggattgcacgtgaatgtgataaaataatctggaaacccaaaatgtttacacaatgtcatcacatccaaatacatgttcctcatatatctaggagcacctgtaaaagtagctggcaaataatatgctaatccttgttctttcaaatcactctttccttcctctgaagccttttgcacagaattgtaattatctacctcatactactctagttaagtttgatgtaaccaagccggttagaagctatttctgtataagaatccaccaagaattgctgccacagccttatcgacctaagtaaaatatgcttctcatgttttctttcgtgaattctgaaggcaaaccatggccttatagatatgcacttgttcttggtttttttaccagaccttgtttgatgtttctcaatgcctgttctgaatccatcttcaccataagggaacaatagaggatattgtaaaggaagataacacgaaaggatttcactaattctttgtagtttccctgatttatcttgcacaactatatctctacttggcatatctatagtgaaatctcctggaatcaacatggctacctctgatgatgttggtacattatacaccctgccatccttttcccgtttactaactattctcatataaaaagtctcttctggattagcattgagcatgtccctagcagtccgtaagtgtgataaataagggttgatactattcagcaatttgatcacaacatcaataattttctttctcaagtctttctttttatacttgttagcattaacaccattactattaagaatcaaataagtcaaatttagaacattaaccaatattaaaacaacatcaatgttatataccaaaacattagtaacactataaggaatgaactcacctgagtacttccgatctgttatcaacttcattctttgtgtctacaatatatgattgcatgaactttggaggtatatcattgtttggtttcaaactccctatcctatggtgattctctccgtgaatctggaacatttgaggacaaccactggctgtaacactattttctgtatcaccaccaagtgatgtaaaagaaaatatcatattgtaagctagccctgacattttctctgaaatgtctactgatttcatcgtcattggttagcaatgcataaagtaattctagtgaattattaagaaaagataacttcacttgaccttgcaaacaacatgatgtaaacttgggctacttattcttgactgtcttttcaatacgctcaccatgccacattatagctccataatattcacatgagtaaataggatcaccatgatcaatgtatactgcatttgaaattataaaatgttaaatatagaggatacacagagtactaatatatagtcatacctgttttgttttttcttgaatttatatcaaattgacgctcaaagtcttcatgttcttttcatgtgaaacatagatgtcattagagcttgtagatttgttacaaccttgattgagcatttgcaaaatgtttattataatttatttacaaagtttattgaatataacacaccgtaagaatgttcctctatattttcattagaggtacgacatccctggccaaaagtggcaagcaaactcttctcaagattatcgaaaactgataaaatttttttaactagttcagtaatcttgacactttttttttgtagttggtatatgaatcataatcaacttcatcttgaaaaccattttcaagatcatcatatatatcagactctgaacctaaaaaataagaaaagtttattatacatcacataatatagtttattttaacggtgaagaatatgtaaataattcagttatgtttaatctttaccatctgattctccattactgtcacattctcctaaattcttttgatttcttgattgcagaaattcaggaagaatggtatcatcggttttgtctcctcgtccacaatgtgtgacgccatttatctgaagaggaatgtcattggtaaagtttctaaacaatcttttatctttagacgggtttgatgtctctccttgttccaaattagttaatgtgaatgaagaacttaggttggaatttggtctatgatttcctgaatataacaaaatgttagatagtattaaacaacatgagacttaccaagttgtaaaccatgacttaccaaacggatactgagaatcatttgcatctgaaggtagatcatcatcatatgttaaatgctttcgatatgattaaatagaacttgaaagatcgattcctgctggcattgttaacatttcataaataattcttgttaaatgtagttatgttatagaggacaacctctaaagcttaaatatatattatagattaatcagtaaacttaacttgtttttgatgttaaagatgactccaaagtgccaggcgtttggctaatgcttggtgtatgaactctttgatttgtaatatcacttagaacgctcttaaaaacataactaactggcactgatttcttcacacttggtgcattgaatgacgggggtgtattttcagaagtttcttcatgtctgaaccgcttatcagttgtgttttgaataacattagacaaatctgaagattgagtttcttgaattttttttctttttgacatgaagaacaaataaaagataccagtaaaaacgtgatagctaaacactcaaaactttatgagaaatgacttttctataatatgttaacctagttatgtgctcgtttctttgttctccggccagaaaagattgacagaatatttgcagtgatgttatttaattaaatctattaagatatcaactatttatatggaaacatttttaaactttgttatttcgttttcttaaagagtatttaaattttctaatctatgaagatcttttttttctatttaacaaaactcaagcactaaaggaaatatttgtgattgggagagtctttcttggtatgaattctctcaagtctctaagccaatgactacttattttaaggtaaattctggtttttttataagaactaaattattaactgatatggttcaaataacctagaactactctctcaaataagagatcaattgcagtattttagaatcgaattcacggagttcttttgttcaaacaatgagttaaatattgagattaagctagcagggtaatagtgaaaataaaagagaacaaagtaaaaagacagcaaattgatttggttgtgaacgatttaataaagagctaggaacagagtattctcaggaaactattggttagtagatctagtgaaagctaggttgttaacgaaccattcttaaactcaaactctaattatggaataactggtgggcgtgccgcgaaactccctatatctatagctaattataaccggagaagccgataaactatcaacctaaatatgcattcttaacgagttcaattggtcatcttagtagataggccgattcttattacacacctataaaccagactcatcaaataatagatccaacaccagatacctatggcgggcatatctattgtctagattcaagatctagttaattactctagatctagcattaggcataattaaagatgaagaattctacagataacctagcaaagggggcaatctactaaaccatatgaatccctaatgagaaaccctattcctaacaagcagattactcagacatattggatgaagcaaacaaaatatttgagatagagaaagggaaagaagggatctcttcactgtatatagatctgaatgaaactctcaagaacaatggatgaatagcttatatctctcacaatagggttggcaaagaacttgataaaagacttgataaaagaaacttaggtctaaaaacaatatatatagaccctaaagacgtcaagggactaataatgcaaataaggaaatcttctggggcaaacttgagcttctgtaaactcgaaagcgtctaggtttttgctgggccgaaactgctgtcgatcgacaccaagagtgtgtcgatcgacactcctcgctgattcctgaaccaaaatcgtccttagcttccttttccttagcttttgctccagataatgtctacttatctccattgttgtcccactgcatagaatacctgaaaagacactagaaagactcgagaaataacataaagactcaaaatcctatacctaaacatagataaaatcggtgaaaatcgggttatatcaactcccctagaatttgcttttgcttgccctcaagcgaaacacaaaaaccgaacccgtggaagaggttttgaaaacaaaggaactcccaaaattctctagcctattgccatgatcatccaaactaagtccatatgcctaacaagtctaatcaaatccttaccaacatgtacttctctgcaagcttacacaacattctagattccatacctaaattccacaactacacccaccaggctttcatcgctgggtctcatcaaacaagccaacattcaagatccttctagactcattcatgtactataccatgaacatttgaccattctttatattttttttcttttttggtgttctttctctccccagacttattctttttagagagtaaacaaaggggaactcgcatacttgatcgacaccctcggcattttccaacctttgtaattgatcattccaaataatgtataataatggggtcataggaaacattcctacccctatacactatctgaaagtcgtctcaatctctcattatatttttctttttataagaggagaggaacatattatttttatcacattggtctccataacagctatgaacaaggagtcaagatctatgaatactaactgtttgaagaggtaaaaggaagagcagattagctccagctttagtggttgagttggaaactaggatatcctcaagtctgttggtttgccatctagattttccaatagtcggattgactcgaacctgcagcactcatcaatcaggcaataaacaagagaaatatagatcatgattcctaactaaactaaagaaaacgtttttttttttttttttttttttgaaaaaggaaataaaggaaataaccaaatgaactacaaaacgaaaaatgataagaaacaaaaataaaagcatcattagtaagaacctcccccatacttaaacgacactgtccccagtggcattcaaatccagagaaagcgggaaaaataaatcaaaaataaaagaaaataaaagaaagcgaaaaaaaaaatcaaaccagtcagttgcctcccactaagcgcttgttttgagtcgatagcttgacttggcggagttcaggatgtgggtggagtggtggtggaggattattgctgcctcctcgccttccaaggcggtgtgtaaacggatctggttggagcagcttctggtgtcgatcgacactcattggtgtgtcgatcgacactcttctcgtcatctgcaaaaacaacaagagaaacaagcttttgagggactctaggcttgttatcttgtgaagcagtattcaaataatccaaagaagtaatcaaagataaactaggagaagagatagaagagaacttatcacatagggcctcaagtggtgtgggctgaagagaatgtgcagaatcctctgtttgtgaaacccgagggtgtcgatcgacaccgttcctctgcaactctcattggcgagctgaacgggttggagcgttgtgtgtggctctgtggtgggattctgatcagtctatggtggtgtgtgtgtcttggaggcaatgcaactgataggcttagtaagctctgaaccatccatgccaaactccatctctgaatcacaaaccttgagatagattctccctctcttcacatcaaacttagcaccagctgtagctaggaatgctcttccaaggataaggggatccttgggttccttctcatagtccaggaccacgaaatcagaagggattatggagttaccaaccttaacaggaacatcttcaaggataccttcagggattcgcttggaacgatccgcgaagagaagagtgatggtagtaggcctgtagtgagtcatgcctagtctcctagcaacagacttgggcatgaggttgatgattgatcccagatcacataaagagcggctgaatctgcttgtggagataaagcaattaagaacaaagctaactggttctggaagcttctcaatggtctgaccaggagtaatggtgcagatgtattcagctatgtctactctctgtgccttctccttcttggctttaggaagcatgattgcactaatgtctctggtaagcagcttagcttcatctgagctaattccattgtcaacaagtcgcttgacatacctgttgagtggagcagaagatgtctcagaagcatccttaggaagagtatgaaggatcttctccattatagttgtgcacttggcaacatgaatctcctgcttagaacgacgcctcctcggataggggacaggaggagtgtagacagactcgagctgcataggtacttgcacctcacaaggtgcagttcggatccagtgttgatcgacactagaggggtatcgatcgacaccgtcgtattgagttgtctctgagaaaagcgtcccatatggtgccgatcgacacaggagggtgtcggttaacaccatctctgcaactgcgagattcaactcgtcttcagtgtccaattcttcccacacatcatctccttctctaatcaagatggcattgcagctcttcctttggttagcatcaggattaccaggaagaaaaccgtcatgtctcttgatagattgtgcagtttgagctacctgtacatctagcttcttcaagtgagagctcagattgtcgatcttcccattaagatctatgtagacagcatcaaacttgccattaaactccacaacaagctttgtttggctctctagaatctgctcaagcatcgattccattcttgtctctgatgagggtggaggggggggcttggtaagttgaattaccatagttcctctgaaagttgctttgaggaaaggtcttctggaaagcaggctttcgagtgtagttggaggaaccctggtttcctgtaaacctgttgccactgaagttgccttgtggctgcccaaactttatgtatccctgaccatctatgtagaagactccttcctctcactcagactcaatagtctcttcctcagctgcaaagtggacatgcttcttcccggtgagcaagttatgaactgaatccagcttagcattcacctctgccatctgatttcctgaaatagctccagcaatcttcttcctctcaaaatcagcattcttggtactgttgctgcaagcaaggttctctataagggttgtagcatcactgggtaacgtgtattgaagttaccattgctcgctgcatctagagccatctggtatcttcaatcaactcctctgaagaaggtacctagaagttgtacctcaatgaaaccatgatgtggacaatctcgttggtactccttgaaacgaacccaagcagccttgaaagcttcagctggaccttgtgtgaaggtagacagcttgattctcaactcctcaaacttagcatcatcgtagaagttattcaagaaggctatcttgatgcttctccaagtcttgacgaaacctgctttaagttgcttcacccaagaagttgcttccttagcaagtgaataagggaagagcttgcacagtaggtagtcctccgagactccattagccttgatgctcagaacaagatcctcaaatcactcgatatgatccattggttgctcatgagataagccatggaaaggatgttggccaacaaaagcaaagtagccaggcttcagctcatagtcgttcctctggaatggtgggggtacaatcgctgatcgattaacatagaacaggtctggcctgttgaaatccccaagagtacgacgtggttccgcagctggaggaatagctgtaggaatctggtgttggtgtcgatcgacacctctgttgtgtcgttcgacaccgattgcatctgcgtgctgctcccgatggtgtcgatcgacaccgattgcatctgcgtgctgctcccgatggtgtcgatcgacaccaattgcatctgcgtgctgctcccgatggtgtcgctcgacaccgagccatgctgcatctctagcagctaattgtgcattgagacgcgcttgatcctcatttgcgtccttaggtaggatgagtccatgatcatccaatctctgaccagcctcattgtaggcctgcccatcctcatctctcaaaactccttctgcatcagctctgatgactctgtcagccattgctaatttctgagttttttggttgatgcgttcaagttttcccaagtctagaacagacaagttgataagctccttctgtaaacaaaggggtgagtaacaaaatagaagtaaaaactatacgaaatctctaaactaaactcaatgatgattcccaagaacttcggcaacgacgccaaatttgatattgttcaaattacttgaactactctctcaaataagagatcaattgcagtattttaggatcgaattcacggagttcttttgttcaaacaatgagttaaatgttgagattaagctagcagggtaatagtgaaaataaaagagaacaaagtaaaaagacagtagattgatttggttgtgaacgatttaataaagagctaggaacaaagtattctcagaaaactattggttagtagatctagtgaaagctaggttttaaacgaactattcttaaactcaaactctaattatggaataactggtgggcgtgccgcgaaactccctatatctgtagctaataataaccggagaagccgagaaactatcaacctaaatatgcattcttaacgagttcaattgttcatcttagtatataggccgattattattacacacctataaaccagactcatcaaataatagatccaactacatctagttaattactctagatctagcattaggcattattaaagatgaaaaattctacagataacctagcaaagggggcaatctactaaaccatatgaatccctaatgagaaaccctattcctaacaagcttattactcagacatattggatgaagcaaacaaaatatttgagatagaacgcataaacacagtaaatagaaaaagggaaagaagggatctcttcactgtatatagatctgaatgaaactctcaagaacaatggatgaatagcttatatctctcacaatagggttggcaaagaacttgataaaagacttgataaaagaaacttaggtctaaaaacaatatatatagaccctaaagacgtcaggggactaataatgcaaaaacggaaatcttctggggcaaacttgagcttctgtaaactcgaaagcgtctaggtttttgctgggccgaaactggtgtcgatcgacaccaagagtgtgtcgatcgacactcctcgctgattcctgaaccaaaatcgtccttagcttccttttccttagcttttgctccaaaatgtctccttatctccatatatatatacttacctgaaaattggaatatcaatttcttcaaatttaggatcggtgtatagccttgaaaagccaaactcattaaggagaatatgcttacctgtaaaattttaaaaacatgttaacattataatgaagacaaatctttattattatttagaagtcaaatccaaagtaatgaccatgataatttgtgattctccagttttggagaagagcgacaattagttcataattttaagtaatcaaactgattctatttgaccagtagttcacaaaccactggcacatctttccaacagaaatacaccttacctttcttcccctaaaaagaaactcaatatcatcactaaccacattactaatgattatcttttaagagtagaaatagactacaatattgttccttaagaaaagacttacatgttgtccgcaatcatgaatttcacaaatcttgcttcataatctgtctctctttgacgacaaacaaatgggaatctcctaatgttagaaacccttgtaataatacccattgcatctgaaacgtttaatataatgtaagttaagagaataaacaagatataaagttgaaaaataagttatagaaaacagagtaccgtatgatctcaaatagaaaataagagcggagccacaaactcaaaaaatctacttattgaaagagaaggaacatgccacatgtttgttcttctcataaacttgatatgttttgaacataatgagtatctaacaggcatggtattaaccacaacttgaaagtcggacatgtaataccaaaacccctcttttagtacatccttgtacttccaatgaatgatgccttcttgaatagttgcatcaattcgattatactacataaaaattataaaatttaaaaaatagggtttcaaatataatcaagtcagagggtaagctatgctaatttataaacttacatttgaatcgacatgcatcatcgtggttacaacaacatcttggggtggattatgatgccaaagaacaagaatcttcacatagactctccatttagtactgtgaactcctatgtcagataagaggttcatcatctccattgagattgataagccgtgatagtttatattaggggaaaactcaaagaaaaataaaagtaaactgtaaacacaaagtcggaattatctagtttatattagaggaagagttgcaatcattgagaaaacagttctagaaccactaaaaatcgagaaactcaaacgttatatattgattaaatattataaatactaattttaagtgtaatcgccaagtttgttatttatacgaactttatatattagagagtgtattctaagaatattgtagttaagatatcatatattgttatggaaagagtatatacatattgatactatataggtaatttgaattttgtcttctattggaggttgcaatgtattgtaatttcaatttttatgtaatagaacttgaattaaatttactaatttattaacatatttttcctttctaacagagaaagagctaaagagtggaactcatcatttccatgtaaggttagatactaattactcttagattgtataagaaaatactctataaatatgaactaagttataaccaaaattaaataactggaaatttaatatttttaacagaaatttgaaactcaaacgcttataagtcatacatgcttaaagaaaatacaaaacatagggaaaataaacatagttcatatgtgtattaaccattatatgtgaaaactatctactcaattcatttttggctcaatatacattctttttgcgatattgttatatagtctaagttactctttacttaattacggaattatatcaatgaatctaattaaggctaatatttatatgttttgtatcagttatggaatctttaattgagaatctggagccattgattggtctgattcaacactaataatgagcaggtaatattctaatagtttcagctatggtaattgtttaatagctataatattcatttcgaaaaagtaaattcttaaaacttgataaagtgcaataaattagtaacttgaaaacatcaaatatgagaataggaaactgaaaccataaaataaaaaaaataacacaatgtatgataattcaaacaaacatttcaattatacttcatcagataaaaccaaaatcaacttagaaacaataagtttgatttttaacagcaaagtaaattgcttctacaaatcattgaaaagacgaatctgactccaggatcagttctcaacaacatactcaatcttccttcaacagacccatcatcttcacattcaaaccaacagctgtaacaaaaacaaaatcatggctttttgacttgaatagttagtatctaattgacaaaaataatttatttaatgactttcacatacatgtattgtgtcacatcaaagtttggaaaagatttatcaatgaagatccttgaacacccatgctcgctgattaagaccttagatcctagaacatttgtaaagacttctggtgattagttataggtcacagggtttaacatcataaaggaatgtgactaacatattcatgaattttcactaacctttaaaattagaggctctccagaaccagaggactgtagtgattgactcgtagttataagttacgaaaccaataaatagctaaaaacgttttcagaaacgactcacacacactccctctagcaacacatgatatgatcctatcactacaaccaaccaaaatacaaatttaccatactacaaatataagtatgttcctaacgaatttcaatatcaatatacatattacttgttaacttacaaattatctctgatggtaaatgtcacatatatggcctcatagtctgtttccccttcacgacagacatatggaaacctcgccacagttgagacacttgatatgactctaatagcatctaacaataacaaaagagcaaacaaatacttataaatcttagtactaaggaaatacaattgcaagaaagcataagctatataaataaatcttagattaccagttacataatcctcatattcatattcgacttcatcagcatggatgaattggagagaactttcagtagatatatcacttacaggccacatttttgtgtgccacataaacttgatttcaaaagtagatgatgagtacttaggtattgaagttgatctcttcaatcggaagtcagcaatgtaataccacttgccttcaaataggctaggcttgaaattgttcaaataatccccccaaggtactctatcgtcgattctggttccctgaataaaaagacaaacatatcaaattctttgaactataatagaaaccaaaaaccaaaataggaatccaaaaagattgtttacgcacaaatcttcacatcacagaggatcatggtagtatgatttccaaagatcatagactgattttcccagatgcttaagattttcacgtataggacccagttgttcctgtgtaaacttaagtcacgaatatagtttgtgtcggccataagaagtttctatggtttgatacagttttcagagagagagtagattgactgaagttaacctaatctttgtcttatatatatggagaggaaagttgtaacgattcaatgaatctatatgaaaggtttccatataatataattgttcaaatcctttagtcaatatataattatttgctaaccgattctgtagccaataaaaaaatagcaaaaaaatttgctaatgattgctgcgatgttaagtagataatgatgataaagtatttggattcagtagacatataaataatggttgcttatgtttttgatcccaaacgaattcttcagtatttaatctaaataatttagtaaatatactaactttgttgtcttactataatctcaggcatttgaagtcggagagatagcacactgcattaaggtaatatgattcttcttttactttagtcattttagttatcatgagttctaatccatgacatttttagaagttggtaaagtaagtagtttcagagacaagtaaaataagcaaaataatataaagtactcacatgaaatccaacttataacagaagaaaataaacatagttcataaagcatagcacaattgttttctcataattcaaattgtaaatcgataactaagaaattggactccacactctcaatgaaaatgtcaacatcttcatcatcagatcatgcaaagttacgcctacgaaacagaaaccaaaaataaacaaagttaatatctatatatacaacatatagactaaaaaatgcttaagaataaggctgtagattacagatatttgttcttgtcgattcctcggaaatttggatcaatgtgaacctttgaacaaccataaacacttttcaaacatggatttcctgttaaacaatcacacgatttagtaaatcataaatcttaaatggcttgaaaaaaatctgacgaataagtaataagaaaataaccttcaaactctaaaatgttccaaaaacacagaataatcatcacaagctccatcctaaaattaacatcacttattttcttgtagcatttcctttcaaactcatcacaagaccttcctacaacaacgcacttcatgtactaggacctaaaatatgaagtgaactaaataaataaaccaaaagatatatatatcatactgaatgtattatagttttaaaacttacacagtatctttaattgtaaaagtaaggtatctggattcatagtcactttcctattccctcttcacccaaggtattttcccgattggtgagactgattcaatgaaaaattataataaccaaatgttaaaaatactttgttttgagtggttagccgagtattgtacaaaacaaaaactaaaatactcaccaacaacaaaatttttttcaacagctgcattcttgatccggtagaaatcaaaacactcaatgaaatgacatcttaccttaggagcaacatgttccactgtagtctttcgtaaaaacttaatttggaacacatgagaagagaatctttcaagtgtgttagctacaaccacttcaaagtatgagagtagataccattgtccttctcttagtgtagaattcatttcttctttgtatgcatgtagaggagataatgcatcgatttgatgtccatgagaccatatataaaatctcatcaaatctttcatggaggtttatatttgtatgatccggtaaataacaacaattatagaaataaaaactgtaaatataagtttcataccttctcatcaactaaaattataatacgttcttccccgaagtaattaggaggccaattccacaacttcagtagcttaacaaagacaaaatattttgtttttttaggacgccaattagaaaagttcttgaagtttgacattgaagaaaaactcttttttgaatttagacagcttcttttgagggtttctactgttttttcttgtgtggaagatgaataagataaggagagaatctattgatctttccaatatacagaacttcttattttttcaaaaataattatatcagaaatgaatttcaaatttttgccaatgaatgattacttttttgaatttagacagcttcttttgagggtttcaagatccattgatttggtttatttttgaaaattcagatttaacaattatatttttgatatatcacatcttacttttcaataatataccatgcaagtatattgactataaaattccaaagatcttctgatgttttcatttgtttcagtataatttcgaaaccggttatttgctattcaataagaaaatagagttaggataaaaagtataaatatatagtagaacaaagatagtgaaaaccagaaataaaatctctaacaaaaatagcaatacatataaatgtataaagcatcataaaaattgaaaatgttgttaatacttattaaaaaatataaacgaagtcagaaaaatctgacttttattagatccaaaaccaaaaaacaattgtgaaaacatataactaattttattccttgtatctttctgtcgtcatttttgttgatcctttagcttttgaggtttggggctcaatctctttaactactccttttatcagtagacttccagcatcatctgaaataactttaacctcatcaacattttctattatcacatttgttccaatctcatcatctccattttctgagttaaccctagagtataacttcttagtggtactcgattgatcagccatatcagacaacttagaaccacgcttagatgaaggagtagacagttaagtgtttttatcatcagcacagttctcgttgctatcagttaacatcaattgaccctatacaataaaaattgagaaatataatttgttatatcagtacaaaacacttaataagcagtttgaattgtattaaggtgaatatgatcatacttgttcctcagacccaattgttgatgaatcatattgagtgtcttcaagcaaacctgattcttcttttgctatgtctgttccaaaatgtacttttgtaactttgtaaatatctttaccaccataaatattggctttctcaacactgaccagaaaatggaatgtctttccacacaaatttgtgatgacatcaggtatgatcgtaggatcctcaatctatacacatgtctcacgttagtactcttcattctaccatagacatatagctaatacttgaatgatagtatatatttaatacctcttcatattgtccatccactaacacttcagaagtttgcccaataagtttggttgcattattttcaaacaccatgagtttaatttcagctgtctggtccattacacgaacctcaagcttgtacctggaataaaatgtattgtacatatcaaattaatatacacttaaaaacctttaaattttctgtataccaatagaaacaatttttttttatcttgtacaagataaaagagtaatagaaaacattctgacattgcctccacatttgtgatgctctcttgacatttgtcacacaagaacttaggtttcataggtgtcttaaccatcttaccagtgctggtagattttttaacctgctcagtttttctgttatatttaggacatcaaaaatagaagcaacccaaatcggtatcaatggcaaaaatagaaccaagtattctccattgcccaacctgattccaaaaacaatcacaatattataggtacttcaactaaaagcagtaatttaggaattagtggaaatatacttacctctttcccagcaagtaaatcaacaatcattttggcaggataatcaaaaaaattatccgttttcaccttaattatgtcacggttccataattatcttgaatagtgagagcaagaccatcacttgggagtctgcaaatccacatttgtctgtttaaaatgtttgtgaatttaaacagaacaaagaaggtcataatatatttgcacttacgatttcacgaacaattcaacctcatgaatatgaactggattgattatgacattcgaaacatcaaaagcacttgtaatactaatctcacctttataacagaattagacaatatatgttaactaagacatgcacatatacatccaatattgactactttagacatagttaagggaagagtgaatacctttaaaattattgattttagcatagcatatcagaaccactgtcttctcgtcatgctttacactttttaaagcactaaatactttctcagcaaacacagcccacaaagtacaaaacaaaccctcattgctttaatacagtaacaaacgatttcaatattacttgtttgaaaacatagttattatgaatcaaaaattatatgaaaataatgttctacttgcctggcatctcttatttgaatctctagttttttgtttggtttgttttgagccataatatcatccacttttcccacactcaccacttgacctaatatgtctgccattgtaaagaatactctgttaatattaaaatccataacagacattttgtttgagttaaattaatgatatggaatttagaaaatatgtaccaattagaacattttcatcataactctcggtcttaaccccttcaaaatatgctagatccagaaaaacactatccgatacaggatcacatttaatcacatctgtgttgtggttaaagcccattcgatagctcaaactcgatatcttgtacttgccatacgaaggactcaaagtgaaggtatcaatgatcatccaatcaccaacctttagtgacatgtgaaacttgccaatataatgctttctaatggggatctgcatcttagatccctatatcaaaacaaaataaacaaaaacacataagaacatgttaaatgtttcaaagcgaaatatatatagattcatatatttaatcaatagcattctctcatacattttcatcacatataatgacatctaacgtcaatttgtttgcctccatagatgaaggatcttgacacggaaacgccaatttgttttgaaaggcttgacatcactaagatacgttaaacctaaaggtaaactcattgattatgtgtatagatgagaaagaaaagtgatgctttagaattgatgatattcttgaatatttatactgttaggacttgattctgaaaccctagagcaacaccggatatttttatatatgaaatcataactaaatatactatctcaaaagaatataggaatcatacataattggttgtgatttgtagaatatcttcaagaactaagaatatcttggaaatgaggcaaattattgagcaataaatgtttgctaagactggtgtttaacgcaaatgggctaactgctctctttgacgccaaatgagaaatagaagtgaggcccattgcacgagaaagaggatccgcgcgtcattgaaacgggtcggttacggtcgcggctcgggtcggctgcgaagagcacaaataatgacggttttacccttaatttgttttgtttgttttttcttgtaacgtgtttttgtaaaatggcttaaatggcttgaaaatttttgtcccccattctctcttaataatatatatatatatatatttaaaagacggagtaaagaaaagtttagcgtaaaatgattttagtttctcaaaatttgccattaacataattgtgctacatattgatttattgcctatattatcatattatcccatatattaaaaatcaaaacaattttgtttaattaaagaatatttctcaaaaaaactgatttgtaagtatatctttttaaagacctttttttaatatatacttagttacgtttatatatctaaatttttaaaaaaaatcttagcctataataaaaactaacacatttctaaaatatgatattaatggttattattttgttaaaaataatataatcaatactaaaataaaaataaatattattgttatagttttaaagtgtaagatatcgtggaacctcttttcacaaatagaatgcatattttaaagtaacacataaatagaacgaaacaaaactgatttatgcatggagtctagttctattttccaccacctccgagtagttttgaaattgaaaattttgtttttattttgcttttaactagaaaattttgttttaaactagtagctgaatcattgagaaaaaaatgttaaaatcctattgaggtgggttctctatcttctctctcttgaatttttcagagtgagaccgactaacttattgtcgtctgaattttatccgcttatcaaatcctgtttagtgggctcttttccaacatgcactagatcctttgtagtattttgttgacttttatgtgatatcgaattgactttcaaagtcacgatgactggcgtgaccatcggtaattcttgctgttttgctctcggttgttgatgactcaataaagtttatgtcattgatatgatcctggtgaggaatcaatcccaatttcggcacttggaagatctggagtggatattctcaaaatagagatgacacacgactcaaagacgagatgatggattgaatgactccacaaaaggatgcggaaaagccttttgataagtcgagaaagatctaaattcgacatacgaaaatggatcaatgatctatttttaagagagagtttttgataaaaagatatatgagttctcataagagattacaagaggtttataaagaagaaagaagtattggaacacactctcaagactaccatggaaaatgaaaagaaataaaaactagtttgaaagtttaaagataacccttccacttcttcgctccaaaatgactcttgaaatgctattttcgtcactcctcttgaccagcaaattacccacttggtttgggctcttcttgggcttgtgatggtcataaaattgactggacttcatatatattccattgggccaacttctaaatgttataccatggttcggttccatggacttcaaaatgctccttaggttcaagctgctcctctgcttcaagcttttcctcggctacaagctcttgatcaaattccaagtcctttgtgctttctatgattacatcatcctctcccacttgaaaaggatttgacctcaaatacaattcacctacaatgaaaagaaccaagtaagattcattgatattggaactcacattatacttaccttgcagctcaagttcataagcattgtcgctttttcttcttcttcggttgaatggacaatcgatctttggcatcaaaacaactccaattccagtcctcttaaagagattggacgagagaagatctaagtctggtggctcctcttttatacctgcaatgttgtcaaaccctttggcaaaaaacaagtgcgttatcgtagtcatgaaatcactataaacaagtaaacatggctcagctttaatcaatgcaccattcttgaaatgttcatgtttttcttttatcctaagacaagagtttgattccaaatattctttaattaaatctaactctttctcaatgtttcctaaatatgataaactcatagtaacaattattgaaacatgagaaacaaatcgagttaaagagttacttacctgagtaaggttcacagtgtgttcggtgcttggtatcatcatgactaatggaagtggcgttggatcggggggttcattttggatcaagacattgttggtgaccaactcattctccctaaaggtatctaaaaactctcctggccgccatagataagtatgaaatgaaccaagtgaagaaagatcaattttaggctcttcacgaaaaagtgaagtaaaatgaccaaaatctcatgtggtataagatttgaacgtcctagataatctcctggtctccaaatgttactttgagatacatcatgtatggatggtagtcctataggtttatccagtgagaacatgaccttataatcctgcaaaagagacatcatctcactcggcagcaccggtgcacagttagtcaagctcatgagagcttcttcatagttaagcaataaacatgggtgttttgataacaaataattttaaccttactagccctcacaaaaaaaattgattgcttgcctatacattttcccatgtgatttagccgaagttgattttgataatcttcacgaggatctcttgattgactcatatgatgagtgtttatctcccgatcattagtcttcttgattggcctccaaagtgtacaaccttcaccaaaagaaagcaaattagctttcattcgtttttgggagtttagataattacctcgagttctaaatggtggtgtagcatctggtggtttatccttgaaaaaaatattgcattcagctccaggtgattgtttgtgaacaatgacagcctcaacttgagtttatcctcctaattcacgtggttcttctttaggtaactctcggtttagaactggttgagatacatatggcggtcctttcttgttcaagatggtgatctttgaaacatagtcaactcgacaagcttgtgaagtggttgacaccaaatgatgattctcctcttttgtgcttcattcagttttgtcattctcatgctccatagtatgacctgaatcaacatcctttgacaagaacaagtgcatgacacaagaactagaattttctaaaccttgactaactacttcactacttgagttaggtgagatcagtttcgattctaatgaagtattagttagctcaagttttttagggcaagttgcaactaaatgtcctttcttacgacaattataacaagtgaatcccctggattttaaaagattacaagacttacagtgcattggctcaacgcttaattcaagtgatggttttaagctttgcttctgaactacaactttttcggtgaccatttttggttgagatgttgacttagctttcttgggtttgttgtaagcattgagaatcttcagaatttcatccttcaactgttgttccgctatggggctaagggttctttcttttcttgaactgctaacccttgggctgtgacactgacttttcgagagcgatttgatgcttgtagagcatatttattccttagaagttccttaagatctctccacaaagtgataggtggctccttataatataaacgatcatcaacttcttgcaaccaccatttgtaagcgtctcccgtgaggtggctaagtgcacaaacaaatctcatctcgctcaagaagtttttgtaggaaaaccactcgtccatgtttttctcccactctaggtaatcttcttttcctgaaaatttaaaaaatgcattagtcggtttataatcagaatgaaacacagatttggatttgggagtgtgagggattttctgtgggctgctctgtgttgatctcagtgagttgtctggtggcttagaattaagctcttgttccttcctttttcgtgctctgtgatgcccttgacgaatttgatctaagtggctgtcgaaaatttgttccatttcaatggtaagagcttcaattagacgattgttgcggttgtggcttgatctctcctcagttgttgacattgcgacctgagaaacaaagcaaaaatacaccagtaacaagtgctttttgtaatagaaaggattcaacacaagaaacacaaaatgacccttcaacttacacaaaactctcctacaaccctaatcacgactgttcgacttaatcggacgctaaaaattatcaaatagtttctaaaaattctaaaaacaaatttacaaaatactagactctttttcgaacccgtgacaagtgatttcgcaaattcatgacacaccaaataattatgaaaattaaaacaagatgacagacagaaaagactcaacctccaagtgttctctgataccacatgatatgatcttggtgaggaatcaatcccaatttcgacacttggaagatctggagtggatattctcgaaatagagacgacacacaactcaaagacgagatgatggattgaatgacgccacaaaaggatgcggaaaagcctttttataagtcgagaaagatcaaaatttcacatacgaaaatggatccatgatctatttttaagagagagtttttgatataaagatagatgagttctcataagagattacaagaggtttataaagaagaaggaagtcttggaacacactcacaagactaccttggaaaatgaatagaaataaaaactagtttgaaagtttaaagataacccttccacttattggctccaaaatgactcttgaaatgctattttcgtcactcctcttgaccagcaaattacccacttggtttgggctcttcttgggctggtcataaaattggctggacttcatatatattacattgggccaacttcagaatgaacaacagtaaacgaaatcaagaacagaaactaaatactgaatagataaagagaaatccatattacaaaaggtctagaacacaaggtctgcggaataaaactagataaaaacttgtctgcaaaaatgtgaagtacatgctacttatagccaaatattccgaaatcctaatacttaaaccgacgaagtattgggacggattaagaactgtacttgacccacgtggtcgagtgggaggtcgagtgaatagctggagtcttcttttcttccttgtgctcgagtgtctggttgagtgcgggatgacgaagactctgaagcttgccatcgagtatgtagtcgagtggtggtgatggagatactcgacttcaaggtagagtggcgagatcgagttgtggtctggcaatgaaggtgaagacactcgacctcggagtcgagtgatgtgatcgagtgatggtcaggtgatgggatgaagacactcgacctcggggtcgagtgatgtggtgaagtagtgatgtcctctactcgaccagggggtcgagtgatctgttctgatctagaagctcctactcgacctcggggtcgagtggtttgacatgatcaggtccgcttcttccagatagctcgtcaacagctccaaatcacctgaaatcaacgcaaatatgcaacatgcatgcaaatctatcctaaacatgtaaagtgatgaaaaatgatgagaaatggtataaaacagtgatgatatgatgctaaagtgatgacaaatggatgctcaaaacatgcaaaatacacacttatcaactccccaaacttagtctttgcttgccctcaaacaaataatcaagaacaaggtggaggtgaggtttgaaagcggggactcagagccaaagcaccagataaaccagatgaaatcaatgtccaagttgaaagttctaaggtgcaagatcgaattctacttaaaaacattagccatgcctcatcatcaatccgactcatatgctcgacctacacaagttttcaaatctaccaatccctttaacattcattagttctggaacgtgaatcaagcaatgcatcatcaatgaactcatttggctaaggtaaaaggtcaagagacaaagatggtcccttacagaataggcttcagtaacaggggatctctcaaaaaatgattaagctttagtagaatgctaaaggtaagtcccaagctatgcatacagagataagatcccatctacccagaatacatcaaataaagctctaatggtaatcccatctccaatcccaatataaaaacttaactctaccctttgcattcatgaatcttttaagccttttttctaatcattcttttcttttctcttaactctaggagaagctttctcaacactttgatacatctagcggatttggatttctttaacaactaaggttcctgtttttaaacattctaaaaccaagggcttttgcccatcttcaataactaacaagaactctttcttttctttacaaatcccaaaacctttactagattttttctgcttctttagcttacttcacctagagtcttttaccttttcttatcaatgaatcaagcccttttcttcttttaaacacatcccaacccaaagtataagcgcccacctagtcctatctagtccgaaaaatgcgaactagaactacatgagacactatctctgtcgttacgaacctaacactttctaccaagcttaatcggaataagacctcacaaacactcacaagtgatatagggcttgaaagaaagtctaggtttgggtttgggtttgggttaactgctctaataaggagagtcagctacttgaattaaaagagtgatcaaaatgaataagaaaatccaagtattttagggtatccatgagttcaaatttgatgcagacatgataattaaagatcagattcaggttcaaattgatagggaatggtatcagatcatgacagtgtggtcgagtagagcaatctaggcatggttcagttttatttcaaattcattgactacgcaacagacaactagcaacgagggcattgagtttatccggtgaaccaaaatgcttacaacgctatctcatcattatcccctatgcatatgcaacaatcctaaatgaaacactctagactcgatcctaaatgtaatgcaactacatgaacactcttttttttttgtgaaatcgttttctgaaatttttcaaatttttttttggtttttctatgccttagatgaatgcagactcaaaaatatacacaatgcaacacacacttcctgagccctcccccaaacttaaatcacacagtccactgtgcgcataaacttggaagagagtactcaggacaaatccaatcacagaaataaaatgaagaaacaaatcacaacagatggtataatacaatggtgaattgacgcgcttacctcagtcgaagaataaacgtagttgcttgtcaatggctgcctgtgattgctcccaggcaatagacgaaccaccttgttctgtatcagctccaacaggtgggtactcgacctcatcagctctgtggcggccagcaccgctctgtggatacttgacttctctccttatgctgcggccagcaccgcggtcgagtgaccttctcgagtgaatgaggcgtgatatgctgctagatcgagtgagtgtagccttccttcttctcttgtgctcccgggattcgaatgacgaatgcctagccgggacatgtgagactctctgctcgctaagctcaggcctgtgctcaggctcatcaaatctcctcgatggcatctccagaggaggttgtccctgtggaatagcagtggtggaggaggaacaactcagcttatctgtcagaagcttgatagtcttgaaacacttggcgagcagcttatcctgcttcttgcaccacttttgcagtttactgttgttcttatgagcttcagtcaagctcttgctctccctcgctggaggtacatgttcaccaaagtgatacatgctagtgtcgaactccactgctctgtcttcatccatcccatccgaagcagcttcttctagaagatcatcttcatccaatgacggagcgttcccatagtagaggcgtccaacctcaggccgaaaatcaatgttatctccctctattatccgtgtaacctcagggctggggagaaggatgctagctctcttgtctgtagaatgctcaaacctgaacctgtgcaagtcgtcaaccattgcaaactccaggaattcgcagtgacgtaggtgctcgatatccattgctcgcggctcgagtccatcagaagtgattgggactccacaagcgatcagaatcggtgtcacaacaccacctatgcacagagcgcctcgtgctctcttgtggttattgctgacagcccagctcttatatccacagtagatggatcagaagaagtatcgagagaggtgtgtcattgatttcaccttggagagacatgccattcttagtttggcgcagagttcccttgagagccattgcgatcatctccatatcagagttagtaaccgtccctgtgatctcttgggagtagagtacattggctatagaacgtaggaagtacttgatgacagcgctgcgtatctgattgctctttgacctggaagaattcagcggtacagagctgccaatggtgatccacaagtctttcaactcttctctgtcatacttgggccttagatcccgttccactggggaaaccaaacaattcttccaatcgcttgattgataacctatactcacgaccatacacagagaatctcaagaatcccaatccttcacaatccaactcatcagaggtcataccttggtaaagctccacttgcagcgtggagaggaactgaattgtctcatcttcatatgctacatacggataagccatcagagtgtccatatgacaactctggtacaggtgctgaacatcctccaacaatccgagttgtgcaagtgtggtcaggcaaggatacctcatgctacagaactcattcagcttgaagagcctaatatattcctcagcaggcaatacgtcgggcttgtgcagaagtttggtagctctgcgagtatgctcaggcatgtactcatcttccagatattcgtctataagctcatacctctctgtcatcgctctcttccctcgggctatctcagcttttcttctaaagctttcatattctctttgttctctctcaggccttgaagaagacgactctgtgtcatccatgttgtagtcaggatcaacagaagaactgccactgtaattgctcatgattcccctgtagaaatttagaactcaaagctcaaatgtcaataggttagtctcaaagatagcaatgaagccaaaattgttatcaatatgcaatgaaatagaccctattgatcgagtacaattctgtactcgagtagactgagctgttcctgagttccccttagacgaattggatcgagtatcttctccgaatttgagttggaatgcttcagtaggtcgagtgagtcgtgaagcctagaggtcgagtaacttctctgaagttgaaaggctctgttgaattcaagaacaagaaaccgagttgcttttgtaggggtcgagtgctttatggtcgtcgagtgaattgttgaaatcggttgaggcggcgtcggtcgagtgcggctacgagactgggaaacaaggtcgagtagcttcttttgaaagagacggcggttgatgtggatgaatttgtcgagtatataaaaggaatcgagtgaagtggtctggtcgggtgacggagggaatgaactggtaacggcggcgcggaggtcgagtggctctaggaggtcgagtgaagttatctggatcgagtggctctttgaacggcgattcgtggtgtagagagattggagtgtcggtggtgagatgaaaagaggtaggtcgagtggatttgttgaagtcgagtgaagcttcaaaaagagtggttgaggttgagttttagattctctctccagtttatcctaagcgcgtggcccacactctgttgactgagaaaatttgcagaaaacctactgtaaactgcaggaaatccctgcaagtctctgtagcttctccctgcaagtctctgtagcttctgttggtcgggtaaaataatgatttaaatttttttgggttttaaatatcactcacactcgaccaatgtactcgatctctaggctctctgtagagtaaaagttttgaatttttactctagcctcacgttattcctctaatcctgagaaccacaaacacaacaaaaacaaatcaaaaataacaagaaagtaaaaattattcacaaggataatcatgggacttcctcccaagtgagcttgtttaaagtctctagcttgacacctcacacttatcaagaggaaaatgaactatagagagggtctgcataatcctctctgataccatcatcatactcagcgtcctccctggagaattgtgcagcagaatactcaattcccctctcttcaaaatatgcttttttctcctctggagggtaatctgtctcttcagaccatcttgaagtgaacttctttctcgggatagtgtcaatcccgcctttaggttgagcttctttctgcaactgattcagcttacttctaagttcctcaacagtgtgggctagcttctctatagtttcatcttgcttatcagacctctttttaaattctttcactctttcagtctcatattcttctcttgagatcactctatcatttccagaggttcttccatcttctgttaacccttgtggagttttgttgatgccaaactgcaacttgatatgctttccaaggttgagacttattttcccttccctgacatctatcactgctcccactgaagctaagaagggtcttcccagtattaaggaatccttatgctctacttccatatccagcaccacgaagtctgtaggcacttctactccattaatcatgactggtacatctttaagcatgctgaagggtcttctggaagacctatccgcaaggatcaaagtcaggtcacaaggtttataccgaataaactctaaccttcttgccacagagagtggcattaagctgacagaggctccgagatcgcacaggcaatcgctaaaagctaattccccaatggaacatggtagagtgaaagatccaggatcttctaacttctcttgaacaatcctcttatcagcagctcgagatggagtgcatcactttcatcatctgaatcatgatacatcttgatcctttccagtatcaaatttctcacatctttgtgaggatcaggaatcaggttgagaacttccatcagtggcatcactacttcaatctcgtccagctgcttcgctgcaacagacttgtatttctccatccacgctttcctgaatgtccacggaagagcacgtgagggtagtggagtaggtttgaatcgttttaccattctctcgattatggcggccttctcttccgaggtggattgagtgagatggcgagaaccagcagaatggttgaatttaacaatagagacttcaacttgggtagaagcctccccttcttgaacatcactgtccccaatgatgaaatcagggacaggtcgagttggcagctctcgatcatggcatatggtgatggcgttagcagctgcatactcctttggattctgtattgacttcccaggaagtcctgtaacttttggtgtagaggtagatgatgattgtccttccaaatatctgactttggtattcaatgcctccactttggtagctgcaatccagcttatggtgcaattcagataatttcttagcaatttccattgagctagatgattgtccctgtagcagctgttgtaccatctgtttcatttcagcatcaggagcagcaggaccttggttttgctgaggtgcaaacccaggtggtggttgttgttggtagttcccctgaaattgctgtttgggaacgaaaccttggttgtatggaacaaaaggtttgttctgcccttgttgttgctgtggaggatacacctgatcctgagattagcaacgttggtgctgcggtaggagaggttggggttgttggttttgaagttgttataccctttgtagccaccttggttgttgttgatgtagctgacttcttccaacaggttaccctccccatcttggacttgaaactgctcgtcatcaacaaggaagtgcacatgcttctgctggctaagaagaatcctgtccagcttgtcattcagcgttttgatctccttcctgtgtttgtcatcagagtcagctgtgcctttgacggtcctatcgcagtcctcgttgtaattaccatctgattgagcaaggttctcaaccaattctcagccttcttcaacatctttgttctggaaatttccattgctggcggtatccagaagcattctgatgcgtggtaggactcctctgtaaagagtgctgagcagagaggctttagtaaagccatgatgagggcattggttggtgtaacccttgaaacgctcccatgcttcacataagctttcaccagtcttctgtgagaaaccagaaatctcatttctgagtcttgcagttctggcattggagaagaactttgatagaaaagccttcttacaatcatcccaagtggtgattgagtcatggagcaaattcttctcccagatgtgtgctttgtcgcccaaggagaatggaaacaaacggagcttgaatccgtcttcactaacaccattgatctttgttaggttgcagagcctatcgaattcatcaaggtggtcgagtggatcctccattggcagaccatggaatttgttcccctgaatcatcgagatgagaccactcttaatctcgaagttgttgttctggatagcaggaggtgcaattcctttcctctgacggtgatcacgtggtgcatctccagcaccaatgttggcagggccattttgttgattctattcttcagccatttcgactggttgctgaggtacaaggttgactgtgtttctcctttctctgagttcgcgagctatgtggtcgatgttgtcgttgaaaaggaggttctgattgcctgttgatcgagttcgcatacaacagaggtgtacctggatcaagaagacaacaaggaaaacacacagttagcaaccgatttgaaaattgaaaaagaacttgatctaagcaagtctgaaatctcaaatgtaacaaacaaacacccaatcggcaatggcgccaaattgataataggtttttaatcaattaaacctaaaacactatcatgtcgttgtagtactgaaggttgtcaatccaaatgggtgtgatgctaacaatcaagatgtgatcagaagtcactaagtcaagccaagcaataacaggttttggtgtgttctagcagtcctaagtgaacctgcagaaaacagaaaatcaagcagaaacaaataaacactcgaccaacacagctcgttacagagcactgggtgtggtcgagtgacaggtcgagtaacagacagaaaatgtaacagggatactcgactgcacagtctgttgccagacaactgggtggtcgagtaccaggtcgagtaacagtaaagaattgcagaaactaagcaacagatgacaggatgcagtaaacagcagtagagtaaacaataaaatcaatcaaataaagaattcccgagaatggggtaatcgagtagtttcgtttcctcagtttacaagtgattgacatgctcaataaattaccctacacaacaagttcattaaccaaatctaagtgccaccgcaacagagaccctcaagttaacctagtcccagactcaatcaccattgacgagagctaacctaacaagcattacgaatgaacaagttaaagccaaaacgctccctgcaaccaataccttggtacagggccacgaatctctgaaattagtggttcagacatttcatcgaacacctattgggcgcggaaatgtctgggctcaaattccagttgatcagaaagcaataggcattaagaacaactaatccagaagggatctatcaatcaatactcaaccacctagcatactgagaattctacactactctaacccatcctcagaaacctattcactactcagacatcataacagaaagcataaacgttgaacaacttgaaaacatgataacaactgtgtaacagcaggatgataacagaatgaacaacagtaaacgaaatcaagaacagaaactaaatactgaatactgaatagataaagaaaaatccggattacaaaaggtctagaacacaaggtctgcggaataaaactagataaaaacttgtctgcgaaaatgtgaagtacatgctacttatagccaaatattccgaaaccctaatacttaaaacgacgaagtattgggacggattaagaactgtactcaacccacgtagtcgagtgggaggtcgagtgaatagcttcttttcttccttgtgctcgagtgtctggttgagtgcgggatgaagaaaactctgaagcttgccatcgagtatgtagtcgagtggtggtgatggagatactcgacttcaaggtagagtggcgagatcgagtagtggtctggcaatgaaggtgaagacactcgacctcggggtcgagtgatggtcaggtgatgggatgaagacactcgacctcggggtcgagtgatgtggtgaagtagtgatgtcctctactcgaccagggggtcgagtgatctgttgagatcttgaagctcctactcgacctcggggtcgagtggtttgacatgatcaggtccgcttcttccagatagctcgtcaacagctccaaatcacatgaaatcaacgcaaatatgcaatatgcatgcaaatctatcctaaacatgtaattaaagtgatgacaaatgatgagaaatggtataaaacagtgatgatatgatgctaaagtgatgacaaatggatgctcaaaacttgcaaaatacacacttatcagggacaagtatctagctccattgagattgctaaaaagatatctgaattgcaccaaaagctagactgcagctacaatgacctgaatgcaaaagttgaggcgttgaattctaaagtcagatacttggaaggagaatccgcatctacctcttctcccaaagttacgggacttccagggaagtcaattcagaatcccaaggagtatgttaatgttcatgctatcaccataaggagttatccactagagagagacccaagtcagtcactgaggatagtgcatatcaagatggggaggattttagtctcaatgaagatcaagttgacaaaccaactgaagtactcgagcccatactcgaccgtgatactcgaccaaccaatccattaacatcatccgctgctctaaaactagttgctgctaaaaacaatgagatagcattcattcctcctccttacaagcctccacttccatttcctggtcgacacaagaaagaggtagaagataagtatagagctatgtttgccaagaatatcaagaaagtcgaattaaggatacctcttgctgatgctctcacgcatatcccggattcccaaaagttcctcaaagacttgatcatggagagaattcaagaggttcagaaaacaacagttttgagccatgagtgcagtgccatcatacaggagaacgatgtctcagaaaagctaggagaccctggttcattcactctaccatgctccctaggttcattgactttcaataaatgcctttgtgacctaggaccatcagtaaatctcatgccactctcagtagctaagaggttggtttcaacaagtataaaaactgcaatatctccttgatcttggctgataggtctgttagactacctcatgggttattagaagatttgcctatcaagattagaaatgtggaggtgcctacagactttgtagtgctaaacatggatgaagaaccaaaagatcccttgatattaggaaggccgtttttagctacagttggagtaatcatagatgttaagcaaggaaagattgatcttaatctggggaagaattttgaaatgaagtttgatatcaatgatgctatgaagaagccgacaatagaagaacagaccttcttagttaaggaagtggatcggctagctggtgaactgcaagtggaacttaaagaagcaaataattaaaaaactgttttgactaagagtggtaaacctgggtatctccctagtgaaactttgagttctgagaagtcattagagtcacacaaggcagcagttggctcacaggtttacaagggcttgatggagtctgacacgaagattataaaagctaatgaagtaagttcaacacatgctcgaccaaatgattccaccaacaactcaaagaagcctccaacttgtcctgaaagctcatgctcgaccaaacaactcaaggcaagcattcagacgtcagatgattggttagaactcaaggggagatctaaatggtaggacaaagccatacaaaggccaacacatattgtgaaagagctgaaggatcaaatcaaggagctcaatagaaaactcaaccaagtaccactcaacatcaaggacgcccctgacaatggagccactattctggtcagcaaagaaggatgtgaattcacatcggaatggtatagaggagaagactatcttaataaaaaaagaagcttactatgaggacatggccactgagtacccaattgcagacttgtcaagaaatcctaatgagtatgatgatcactctactcaagaaggagaggagacctcatttcctctctccaatccaccttgagcctaatgagtatgagaagtcaagcttagagacataaaagaggctcacttgggagggaatcccatgtctatctttgtacatatctttatttttccttattgtttttgatgcatttggttagtgtcttcaggagaaaagtataaagagctgagtgaagtggattctggctctgagagtacagaagtatactcgaccacagagcaatgaaaaatactcgaccatgttttagcttatccacgctaggagatcactcgatcacggtgttggccgcaacagaagaagggagatcgagtatactcatggcggtactggccgccatagaggcaatgaggtcgagtaccgacatgctagagctgagacagaactgggcgactcttcactagcctgggagcaatcacatgtagccattgatgaccaactccgttcattcttcgactgaggtaagcgcctcacttcaacattgtactatatcatctcttgcttatattttgtttctgttatgtgttttgtcctaagtactctcttccaaattttgccacacagaggactatgtgatttaagtttgggggaggtctcaggaagtgtgtgttgcattgtatatactcttgagttgagtctgcattcatctataaaaaaacaaaaattgaaaaatttcagaaaatgatttcacaaaaacagagtgttcatgtagttgcattacatttaggatcgagtctatagtgtttcatttaggattgttgcatatgcataggggacaatgaggagataaccttgtaagcatgatgattcactaaatgtgttattagttctttgatgcatttgaatgactttgaagtaaaaccgcaccattttctatagaaaccacttgttgcatatcatgacatatttccctgtcaatttgaacttgaatctgacttataattatcatttttgtatcggttttgaactcatggatagaataatatttggattttctttcatttatttaccactcttgcttatccaagtagctgcttctattattggagtagttcccccacccttaaccaacccttctttcaagccatgttatttgtgagagcatgtgaggtctattttcatgattgagcttggtagaacgtgttaggtttgagccgacaagagtagtatcccatgtagttccaatccgcgtttttggacctggtaggactaggtgggaacttatttggggattgagattgagtgtgaaaagaaaagaaagaaaacgagttagaatctttaggagaaggaagctgaaaatcatattgataagatatactctagtaaaaaactggcaacaacaaccgaaaaaaaaaagaaaaaagaatcataagagccattagagtttaagaaaaacccaattcactagactagactcatagagtttaagaaaagcttctacttaagagcaagagccaaagaaatgaaaggaaatgacttgatccaagaaaaaaatcgaaatatgcctttagtgcaaaatggtagacttaggatcatcattgggtttagagataggaccatctacttgttattcacggtttatgtcattgggtagatgaggtgctattcttgtatgcataggttggcacttacctttagcattcttctaaagctcagtcctttttcattgagagtcccctgttattaaagtctgaaccaccttaaagggaccatctttgtcacataacccgtcctttgccaaatgagttcactagcgatgcatatcttgattcatgttcctgagcttaatgaatgttaaagggattggttgatcttgacgtattgtgcaactgagtgtgaattgggatcataacagagcatgctaaagtttttaagtagaagtcgatcacctcgcattttagaactgttagcatatacattgatcttaattgtcatatctcatgctttggttctgagtcccggctttcaaacctcacctccaggttgttcttaattgtttgcttgaaggcaagcaaagactaagtttgggggagttgataagtgtgcattttacacattttgagcatccatttgtcatcactttagcatcatatcaccactgttttataccatttctcatcatttatcatcactttgcatgtctaggatagttttacatgcatattgcatatttgtgttgttttcaggtgatttggagctgctggtgagctaattggaagaagtggaccagatcaaatcaacatactcgaccacgagctcgagtacagtcatcctggagttcctaaagtactcggccacaacctctacagcaaatcactcaaccgcgaaactctatccaccactcgaccacgaggtcgagtagatgacttccccacttcacaacaccactcgaccccctggtcgattagctgcctgcaccacttcgattcaccactcgactactaggcaacatggccgagtatcaccatcatcattcactcgaccaatcactctaccaccaagtcgagttccaccatcatccaccactcgacataatactcgactgccagcttcagagtcttctcgattccgcactcaactagacactccaccataaggaagagcagaagactccagctgatcactcgaccagtcactcgaccacctgggtcgagtaccgttcttaattcgtcccaatactgtgtcgtttttagtattagggtttcagaacattttgctataagtagcttgtactttatattttcgaaaacaagtttttttccgtagacactgtgtgttcttgacattttgtaatctggatttctcttaatctattcagtatttgcttttcattttgtttactaagttgttcatcctgttatcatcttgctattactctgttgctatcatgttttcaatcttatcatcgtttatgctttctgcaatgatgtctgagtagtgactaggtttctgaggatgggttagagtagtttagaattctcaatatgctaggtggttgagtttgatttatagatcccttctatattagttgttctgaatgtctattgctttctaatcaactggaatttgagcccagacatttccgcacccaaaaggtgttcgattaaatgtctgaactactaattccagagattcgttgcactgtaccaaggtattggttacagggattgttttggctttaacttgttgattcgtaatgcatgttaggttagctctcgtcaatggtgattgagtctgggacttgtttatcttgagggtctctgttgcggtggcacttagatttggttatcgaacttgttgtctagggataatttattaagcatgtcactcacctgtaaattgaggaaatgaaactactcaattaccccatcctcggaaatttctcatctaattgatttcttgtttactatgctattgtttactgcatcttgtaacttgttgcttagtttttgcaatttttgcctgttactcgacctgatactcgaccacccagttgtctggtaacagactgtgcagtcgagtatctctgctagcatttttgcctgttactcgacttgtcactcgaccacatccagcgcttggcaacaagctgtgttggtcgagtgattttactgttctgcttgaatttctgtttcctgcatgttcacttaggactgctagaaaccccaaaacctgttattgtttggcttgactctgtgaactctgattgcatcttaattgctagcatcacacccatttggattgacaacctaaaatactacaacgacatgattggtgttttaggataattgactaaaaagtaaaaacctattatctaatatcaccgtgttaaccgttcccagatttgatctctatttttcggtaatggatctccatatacaaaggtaagattaatagttttacctttataaatggcttcaatatcgattaaccggttactttgatagatgattgaaacattaaaatcattgttataaaacagagctaacctgccactataaccaataaggtcaaccttttttaagtttttatagccaaaatgaccaacaaatgtttccatatatcctatagattgttttttttctgagagaaataataaatctagtcgatgttttttctataaatcccttaaataaccaatggttgcctaagctgaattcttagattataaccgataatataatcataaatggatacttgtaaaattaaccataagaagactcgatagtccgccttaaccgaagcaaaacacataaaaaaggaaaagactagtttttttttattacaacaacctcacaaacaccaatgatctccaagtgagaaccaaccccacaagaaaaaattgaaaccttacaatagatcttcggttctaccgaatacaaagttttaaaaataataaaaaattgcaaaccatgttcatagaacgaacttatttgactcacactttccctcctccactccaaccaaagtagcttacaacacatatttattagtcttttggaggatctcgctctccataaagagagcttgtgcccaccgtagggccaccaggcttagatacagtccgcttccaaggagaagtcagggttccttttccttgagttaacccccggaagaccagccttatttttaaccactctcttctttgcaggcagctcaacatccgcaatctctggatttatcacttcagtaccattgtcttctccattagtttgtgtttcttcctccattttatcaacctccttagtttcctcattaaccattacctcctcctgtgacacttcctcattagactgctgagaaggatctgttatctgaaatgtatcctctttgttttccataatagtatccaagaaacttaaagagttttcctcagcaagtgtgtaatcttgaaccatgagctgattcaaataatccgagaaaagatcacgctgctacaataaatccgtagtagctttctcactctccttaccaacagtttcctcatcaccatgaaacagatttttacgcaccgtctttactgcgaccgcttccagccccaaggtggaggaattgttcgcagcaatttctgaaacatcaacccccaaatcaccagaaactgcttcaagcttacctgaatatgatcctaggaaagcatccatcatctgttgatgatctgagaggctatgactcgtctcaccaaaatcacagtaccaacccgtccagtgggacccagtcggtgctgcagcgcatcaaccctaacctctctcatgtgggcccttctagcccaccatgtaaattattgttgcgcttgacgtttctcaaacccaagacctcaccctttaacaatcttcccataggacaagttgttaccaattaacccacatgagagagattagggttgatgcgctgcagcgccaaccgaatcccatagagtgggttgttacaatcaccatcttacattttatatttttttaattagaaaattttcaaataaaacaatttgctgcaggatttaaattttataaccatcataattatctttttaaattttacatttttaatttaaatttccacataaaaatatttgcagcataatttaaatttagttgcaagtttaataaatatacaaaaatgaatattgtcaaataaatatttttgctacataatttagatttatctacaagttttataaatgtagagaataaaacattataacttcaaaagtattaaccgatgaagtggctaaccgcgattggtcgtttaaaagcttagttggacagcctgagaagcttatagcttctacttttctattttttaaatagtaagatgattaaaatattaattagtgagatgggtaatcgtgattgatcattttttgtagaaaaataagaaaaataacaaaataagaataaaaatagaaatttctaattaaaaaataaataaaaattgacatatttgccatctttgtataaaaaatattaaaatttaaaaatattagtcagtgagatgactaaaaatattaattagtggaatgactaatattacatagattccatatatttttctaagtttacataattactatattttaatataaaaagtaattataattgtaaaaatgttaatttgcaagtttctccatcacatgatgcgttaaaacttttaaaataaaacataagtatttataacattattattataacctcattaagtttttaattttgtttttatggttggttttaaagaatgaaaacactatattacaaagataaatagagttttatccaattaaattaatgttaaataagttatatagttattttaaacttcaatgggctttttaattattattattatctacactaaataatttttttttttaattacatgctaatttaattgaccaataacaaatattaaaagaaatttgttaattttccttattgttaataattttttccctcttttatatatagacatataaattagtatatttagacttattacgcttttttagttttttatacggtgattttgaaaattaccctatttttaagtttttatttgaaaaatacacttttccatatttttaattaaaaatacaattttaaatatgtgaaatgacaattatgtccagatttaaaacaaaagaattattttaaattaattaaaattaaatacgaatttttgaaaaagaaaagaaaaaacttaatttaaatcttaattattatttttaactattttttatatatcttaaatattaaattctaacatattttatcaaaaaatattttaaagtttatcacttcatatttatcacattatataaagaaattaatctaactccaaacacataattctttatttcttttgcttcttctttttcttgtaacaatattttcctttaaaaatttattcaagataaaattatatggaaaattgttagttagttattagcaaatatttttaaattaattttttttttgtgtcgacaaataaacaaaactgattttattttaaatataaatgttttcaaattattagtaaattttagtaaggatatttttgtaattttatattccatttatctcttagaaattatattttaaaagagaaaatatggataggttatttttcaaacaaaaacttagaaaagatcaggcattattccaaattttctctttttatatccaattaaattaatgttaaataaattatattgttcttttaaatttcaagggcattttttaattattattattatccatagtaaatgattttctttttaaaattacatgctaaattgaaatgaccaataacacatttagatctaaatttcttaatttttcttttttgtttagaaaaacaatttttattttattttatatatagatatataaattagtatattagatattttttttttttactttttgtatttttttccaaaaaacaaaacttaaatctcttctgacacatgtcaacatctgatcgatttatttgacatgtggtgcaatcttatgattgttttgttaacggaaatttaacggcatgtcttaaacggcccaatcaacgaaacttagctattttattgagaagtcaacaaaaacttcatgattattctaaatttaaaagttgaggctttttttttatattttttcctctatataagaaagaaaattattgagtctattgaaaattgaagcaaaaaaatggaaaaccgagaacgacgtaattgggctgagtaagaggccacgtattaaagcccagattgttatggtcggaaagtttaagattagagaccacttcacgcgacttaaacaacgaaccaaacctctctctgctcagcttttccgaccaaaagatccaagcgcaagatcaactcaaaatcaatggattatctcggaatcgacatgagctgcgcgatcggatctctccggaacggtgacttcccggagaaagattgtcttcttcctctaatttcaaagcttctcggttattgcctcgttgctgcttcaatcaccgtcaagctccctcaggtattacaatcaaacttcgtctataaactcttaccctaatctcaaaattgtaaattttattggtttttattgtagataatgaaaatcgttcaacataagagtgtacgaggcttaagtgttgtggcatttgagcttgaagttgttggttacacaatttcacttgcttattgtttgcataaaggtcttcccttttcggctttcggcgaaatggcttttcttttgatccaaggtatacgaattacaatcaagaaccctaatcttgaaccctaataattgacactaatatgatttctcttattacctttgcagctttaatcttggtggcttgtatctattattattcacaaccagtacctgtcacaacttggattagaccacttctgtatcctttttggttataggaatttctcaactttgatttgagactctctgttttagttttttcttaatgttacgccgatatagatattgcgctgtggcgccaactgtgcttgctggacagattaatccgacgcttttcgaagctctttatgtgaggaagaagttcttgttttatttactttaggctctgtgtgtgtgtgtgtgtgtgtgtgtggatagattgtgatagtgtatatttgtgttgtaggcttcacaacatgcgatatttctctttgcaagactccctcagatatggaagaactttaaagtgagtctatactacaatactcattttcactatttttgtgattgatgtctcttcttgttgaacttggtgttttgagcttaagtcacgtgttaatgttcagtcatgcctttatgttcctgtgatcaatctatagttaaacttttatagtatagtttaccttacaatcttttgctggatacaaacactgttattattgttcatgattcatagatactcgttttagccatatatatatttctatagattctgcagaagtatactttcagaagtatatatgtatgaagtccaccgggcactgcttatgattaacattactttatctctatctacagaacaaaagcactggagaacttagtttcttaactttcttcatgaactttgccgggtcaataggtacgaaggctccttcgtcggatgtctcttctagtttccagtggatatgtaataatctgtaatctcataatactttttctgtttccctcgcagtgagagttttcaccagcttacaggaaaaagctccaattagcagtatccttctcagataatatttgcttcctattatgaatgctgagcatatatggttttgtaggctttatagaaagctgttgttttcctcaacctttttgtagttcttacgggtttcgctcttggagtcgtcaccaacggaagcatcctgacgcagattctcttgtactcgaagcctgctgctgcaaaggagaagaaagccaattgataggtagaaagatatcctaaatcaaatactggtgttgaggctccaaaaagagattagtcaatgttgcattcacgcctttttctcttttaatatgttcaaggatgttcagactttagccggctactggcttcgacttgattctgatagtgaagtggctgttttaagtctgattgattatttattttgtgttgtgatcatagctaaaatctgaaactacacgaagttgcattgatgtcattggtctgattaccaagatccaaatctgatggaactttgggtttggtctaaggtcagactatatgtttacgtttcatttagatatgcatcagatcaactctggcgacaagttgtgaagacacactctttgacaaaagaacaatttctgaatcaatcaatatgacaacaaacaaacaactgctacacaatacgaagcacactatcaaacagactaaacaagaaaggtaaaactcggttaaataccgtctccaacgtgttaaggattgactggtttccacaccctttgcatagtctattcattccgggacctgcttcgacttcccaaccttctcagtgcacaagaaacaaagttcctctggctcaaaaaccccaatcgtaacttaaacgaggatgaccggctggtgctaccagatgcaaggcctatggttggaatttggagtctggaaggagggaactcaactgcattctcctgtgctccaccttcaccgacactaccctcaacaattggtgtctcgggcgcatctaaattgacaacaagcaacgcccttcttttccttaacaaatcagctccttgagtagtcactcctctacacttcttaaccttcacttttagcagattcggacatccgttcccaagagctttgatgccatcatcagtaataggacagttcttaatacaaagcttcctcaacgccaaacatttctcagcaatacaacataactcagtgtcacctaccgtatcacttccacacaatgccaatctctccaagttaagacaattcgaaacaatcgcttccaaacttaacttagtaggattcacaccaatcaaaaccaactcctgcaaattccaacagtacttagcaacaactataagcccctcatcgcctattcgattcgtcttccatccatcaatatgaagcttccttagcaatttacaacgctcagccaccaaagctaaaccaacattcgtacaatcaggagttttcacaagatgcagaacctcaacacccgaacatttcgataacgcggttaaacccaaatcactcatctgaatcctctctaaatgtatctcaacaatagcgttaaccttatcacgaaccgcctcaaaaacccgatcccaatcccctgaacacctgaaaatcttcaaaatcctaagtcctttagctccacttaacaatggagcaaaacactgaccattatgcagctcctttaagcaaataaccttcaacgaacccgcagctcccccaggtcctataagctcagcaccagcaccgattccgcgtaaccgtttaaccgacaattcctctagacctaaacaagtattcaacaaagcattcattcctttaacaccaaacccacaagatccaaatgaaaccttcttcaaactcctacaattctcagtgaaacctataatccctaaatccgaaatctccggacaaccgcgtaacttcaaccgcgttaaattccgacatctaacagaaatcataacgaatgcgttgtcacatataccaagtgatctacggtcacttctaagaacaagtttagtaacagaatcaaaccgagtaaatagagatggtatcactgaaataagatctgattgtgctttgagagagagacgatgacgacactgtccttcaattgttaaccaccgacgacacaccagtgagcaacgttttaggtcggcgcaagttagcgattggaaaattaaagataagcattcgtctggtaagttagaaatgtaatcgtacggctcatcggcaccagagttttgttcccgtaaattaggtagtaccggagaagtgaaggtagttttagatcgccggaatttggaagtggattggcccattcgacggcgatgcggttcacaatgttcccgcctactccctctggttttggataaattgtcgcaaacaactttttttctttttttttctttgctaaaaatgtaaatattcatttttttctttacaagttttaatatacttcctactaaatatttataatttaaggtttttgcacataaattaaaaaaatatataaatttcatttaatttatctcttttctataaaaacatcattaattataaccaatccaaccaataaacaaatatgatgtaaaatataattggttaaaaactattaaatacatttaatatttacatagaaaagtgaaaacaacacttatattgaaaaaaataaaaaacctttaaactacatttaattaaaaacagagagagtatatatattttttgggatgtggagaaataggcaagaatgccaccctcgaaccgtagcaaacaaagattttatggaggctgaggattaaaagccgaatggataatgtccaaaaccaaataagaccacaatgatgtaaaggccaaataagaccgcgtcaaaataagaccaaacccaaatagattatatttaattggatagtcatagaatctaaataatatatttttttatttttttgttaaaatcacagaatttattttctaacaaaattaaagaattatattttctgcatatcagaaaattttatttttcccgcaaaaagtgtagaattaatttttgtagtaaaaatgtcaatgtaaaccctaatttttaaaaaaataaagaaaaacaagtatctaatatttttttttaaatgaccactttgaatttagacatgactagacccggaccattttaatttgaactgatttaacccatgattttggataaattgtcgccaactttttttttttacaagtttcaagatttttctattgggatttggggatatatgagcaggctgaggattaaaaaccaaatcaaactgtaccaaaaaccaagattttatggttttggttctaattcggttaatagatttaaccaatcaataatttcagaaccaacgagtctcaaaaacaagaaactagttagtatttgaatttttagtttagatatttcctcaggaaaaactctctctcttctctctcaaaaactttagagagagagagtttgattttcggcaaagtccgatcatgatctcatatggccgttctaacctcgccgtccggtttatccggctcctgtacagcatcgactagcttctaaagtagtgttggctggcttttgtccggcaattttgccgtcctgtttacgatgtcttcggctggctttattatctgagttggtgatgctgttttaggtgttgtgtcacttaaaagatggatttctccggcttgtttcttttgagttctcggtttgtagaagtctttacagagataatgtcttagtttgaaggaaagaagaatctttcaaagcatattatgattgtcttaaagctattagtttctttttagagtttcgattaacttagcaacggtgacaaacaaaggattcaacgaccgattgtatttcggcgatgatattctcaccggaatcgatgctcaacggcgaaggttgatgtcggaattcttacgattactcatccagcagcatgtgtcgcgtttgtatccagttgctgacacgtgggcttgggtggagtacaaacgaattttcttatgcagaaggcagttatcggataggctcttgttgggtctcaaatatttctgtaaacttttttgtgggacttttagtatagcccatgtatgatccagttatgtttaatacgatactacacttgcgaaaaaaaaaaaacaataaacttaaaatgaaacaaaattcattttcttaggcggcgacattacacaacatatggattcatcaaagagttaaaaagaccaaaagaaaaaaaggactaaaaacagtttgcttcattcactctcaacatctctatcagtctttctacctagtgtaccatttcaccagacaaacaaaaaattgggcattgatcatcttcttcagacaaacaactccattgtcttcaagttccaaaaatatgtctgtctactggttgattatccaaactcttgacaacatccatccatggtttctctatcaccaggattgagtttttagaaaggtgacccacgaataaaacagggtggtttgaaggtaagatttcgaagttctttcgttcattactcttaccctctaactgatactcatctaaccgacgttttcggtttgtaccctttccctttttcaagcccaagttgacaagtttaccttctagcgttttagacaaattgccgtttggtaaatcatactcttcatcttcttccacaggcttcccgaagtcgatcaaacatttcgctctgatatgtaaacagtatttgaattataaagggttctatgtataaaaggcagttgtggactgactagggtaagtagtgtaaccagtacctggaactgtaaactatcacagatgatgaatttggtgacggggagaatgagagtccaaggacctccccaggaaactcttgatacctctttggcagaacataagtgtttagcaacgaccacttgcctaactgtctagcttctacatcaaaagcaaagacctgattcgaggaggttgagatcacaagtgcattgttattccagggatgaaatccagcagcggtaacagatgcaccatcgagtcttgaaatgaaccagtgctgcctgtgatttaaaaccaacatcagaatacaaatgataaatattaagcaagcaaagcttcacaaagttctcacctttgtgtttcgaggttgaatacatagatgtccccaaagcaattgatagcagctagccactgaccatctgagctagtaaacaattttgttattggaggctccttaggtgttggagcttcaccttcatgctcctccctagatggtgtaaatgcatatactagttccaaactacttatgtcaatagtctgcaaagaaaatatgatacagaagttagggtaacttcagaacaatacacataatttgaacataagaattagattactagcaaagcacgtacatatatccttctatcatgccctgctattattagacgagagcagtccgaactgaaaatcatggaatgtgcaaatggaagttcaggaagtcgccttctactaacactccatggacactttgtaaattcatttttcttcaactcgaacagactggggccaatttggtcagagtaagcaaaatgtgatccggtgttagaaattgcactgcatatgatctttcgggcatctctacttttaacacgaaccaatgactttgttgaggcacgaccactagaatcactgcttatattaagtcgaagaatatctaaagtactaataccctgaaccagtagaagagaagtcttattgaacatcgaattatgtaccatttgcatgggtattctctgaggcgcaggacatatatcatgtggggagaacttagtaaattcctgaattgaatatgcaaaaagctttgcatcatcaccagcagaaataagcatcggaacacccaaatgagcccatttatgataagtgaagtcaaccggcttcccctttttgcgatgtttacgactcgctttatctggcagtatatcatccggaaaaggatctgcaaaaaaaaggggggacctaacagctgtatgtatgttcgtgtgtataagaattaaagaccaaccagcttttagatatatgtgtttgtgtgtatattggctaaagtgtgcatcaaaaacgaaatttgattgcagagcatatttaaaaaggcattctcaaactttgaataaacataaatcgcaataagactctgaccttctcgactaattggtacagcaactgtaagagctctgatgtcatgtgtatgagccttgacataaccaatatagtcccatttctgagaggaagaaggcttcaaatcttgagaaccgttagtactaccagagagcttataaaggataacctacagaggatgaccagagaattagaatgttgaaaaccattgcaatgaaacaaacacaacaaacatttcagaatagtacatatatttaacttctacaatttgtcaaagtatctgtctctagtatagtggtacaataatagatcccatatattgtcaacacgaaatatttcaatcagcaaaaaaaatctacattaaaaacaggtcttcacaattaccttgataatctgatccatcatcaactatattctaaaatcattgtataacagttactgcattctagtaatttcatttacctgtccatccgcaccagcagaaaagactcgattatggctgggggctgctgcaagagtattgacatcacctttgtgattagagtgtgcttccaaaagggttccatgctcactatcccaaaactggacagttcctgtactatctccactcacaagaactgaacacctagagtaagcatgtagatactcagcaagagaaaaacaaaaacagacacaaagttaaagctgaacattacaatcagtacctcaacgaaagaagtgaccaaacacagatctcagaactacttcctagtccaccaagaccagctgtaattctgtatacctcatgacacgaggtagcgtcccagcatcttatcagcctacaaatgattgttgcaacagaagaaacagttactcagaataaacttaacacgtatatccaagtaaacaatgaatctacaaaaactcacccatcactgctccccgaaaagatcctttttgcatctggactccatgttacacttaaagcacgtcctgtgaagataatattctatgaaactaagtaaacgaaacaaagattgacgattgatataaataccataacagaggtggtgaaagatgactcaccactgaccctaggcaatgatctatagtaagttaacttttctaaattagagatacggtacagtctcacacaaccatcatcacaagcagctgcaagaatcctatctatctcctcctctgacttctcatgaaactcatcggaatcagaaccatcttcttcactcccaatctcttcctcatcattcgatttctcactcaagtatccattcttaataccttctacatcactcgagaatccgctaatcggagccaatgccatttgccatatcgagattccaatagactcaagcacaatctacacaacatagaaagacacaaaacactgagtatcactctcaaaatgtgaatcgaaaaactgagagatatttttgaaccttctgcttcaaatcgaaaagatcccattcagaaatagagccatcgatgctagaggagaataaccgaccagaaggaagccctatagaaggagaacagcaccacgcaagagacgagattctcgaatttggatcgccatggatagtctaaccccggaaaaatccgaaagaaggcaacggttaaattaaaaccaatcaaaaaaccacaaatcaactcgaacatacttcacgagattccgattcgattgaaatcggaatagagaagaagctactagcgtagagtacgtacgagttgacagtgccatccgacggcgccgggggagacgagccagatttcaagagaaccgtcctcgcgagcggcggcgacttgagagtcgtcggagctgttagctagggctaccaccggtgatggtttccagtcaacggagctgcaacggtactcgagcatgacggaagcagaaggagaagtgtacactctctgagagacggagatgagagaagaagaagaggaggcgatgaagtattaggtttttgaggattttacctaaggaccttatgggggcggcaatttaaaatgggtctgggtccggttccgggtcgcccgcacacgattcgacccgaccggaatcattcattggtttgaaatttatttaatccctatgaaaagtacatattctaaacccgtctagttaaatcaaaaattaagtttcaatttaagttaatttataggtaatgtttttagatagatttttttatttcaattcgatttcagattgattatataaggaaatatctatcaaataaaaactcttaacaaaatctaaacaactccgctaattggttttaaaaaatcgagtcatataccacgcaatcattcctacaaataaggtaattactagatattgtagtcttaatattctctaaactataaaatctccattcatatctacaatatatgttacttaacgctgccggagcggcagctacgaagtaaaacgacatatcatgaaaagtaacaactaagtaaaaaacgataccaaaactcgaaaataacagatttagatgattcgcggatgaatggtgatgagtaccaacgacatcagatgagtcgctgaaatttaacagcagcatctcaatcttcatcggcgttcatcttctgcgacagtttttctctcatcactgtactttcttctctttgcctaattgtttttcttcttttttgccgttgccgctccgttaagtaaaagaacatagcctatctttatatatgacaactaaaactttgtcattcaattagtatgagtgaacattgtaccaacttgaggaacacattattctccattttcaaactcggcaacatttaattacgataataaatttatacattaaagaatttttaagaaactaatcttattcgcaaaatcataatacggaatatgcttcctaacgattataaattgtgacccaatactaaacactataaatatatgtttcgtaaaagaaacataattcacatcaatcaataccaaaaaaacactaagaatctctcatgtgctgaaaaatagtaagtttgaattggacaacgtaaatgaggtgtattaatcgaaatgttctgattggattttgattttaacgaggtgtcatggcctatctccaccaaagtactttcaaaactaaaatctatataaaaacatgggcctaaacttccttatctagaaaacttaggccggagcaaataaactgaactgaatgtaccgaactgaaaccgatgcaaacaaactgaaccaaaccaaaccaaaaagttgaaaataaccaaatggatattaaattctataactgaaagaaccgaaacattttgggtacaacagaaatattttgggtaaccgaaaatatccgaaatataattataatttcaaaaatattagttatttctaaactaaataattaaatatatatacaatagtaaaaatactcgaaagtaaccgaaaatatatgaaaataacaaaaataaccaaaatatctaaaaatattcatagaaaaataaccggatggatattaaattttaaaaaagcaaaagaaccggaaccaaaccaaaaccgaaccaaaatttcaaaataaccaaatggatactatactttataaccgaaagaaccgataaccgaatggatacaaactgaaactgaatggataaccgaatgcccatgactaagaaaacttatctaagggcctgacttgttgaaacgcagcggttacggttatgactgcaagagtttacggaatcgaacggttacggtttcaagctttataaaatattttgaacgactagtttagcgattaaaaataggtgcgattgcgggagctttatgattgactaacggatttacgtttatggtaggaaaattacggttttatgtttttggcgggaaaattatgggtttatgtttttggcgggaaaattacgggtttatttttttggcgggaaaattatgggtttacgtttttggcgggaaaattacgggtttaccggtttttggcaaaaaaattaagagttaatgtttttggcgggaaaattaagagtttatgataatgttatcatcatgatgatagctatcatgactatgatatgttgatatgattatgatgaagataatatgatgatgatggtgatggtagtatgatattatgagagggtaatgatgatgatgatatttagttgataataaatatacggatgggtggatgaagccatttgaaaaaagatttttgatattcaatcggtttagaaattttgtgaaactcaaattgatatcggtttagagatttaagtttgtttaattcattttaaccaaaattggtgggttcattgcaacccaacttatttgatcaatataaccatttgactcaataacttatttgaaccatcaactcatttgagtcaaatatttcaactaattagatttcatggattgagttgaattgggttgatccatgaaacttaaaccattttgacaaccctaaaaatagcctataaaaaacaattgaaaatagagtaagtgtatttttccaatgtgacctttttttattagatacttattaacttgataaacaacctgcactatatgcaggacaaaacagttattaaataattttaatgtattgacgataatgaaggtgttctatttttatattgttacataaacgatagtgtattaatgattatcaagattaggtaaatttttattttatgtatttctaatgtttatgtttattatgctctctatatatatatatatatatatcttaatagatacacaaaatgttaagtatttccttttgtatagatttgtatattttaattgcatatattaatcctagttttgttttaatataattgagtaaatttaaaagcagaaattaattggagaaaaaaatcataagtaaaactaagggaatattaggctatgagacacttttttaaaacttaatttggctatggggtactttagaggtagtgagcatttattttaagtttttttactactacaccctcaacccaacctaactaatccaaactaactatggttaccaacctttattttttttctctcttcattcatttttctttctctccactttacaaaagtaaatacaaaacatttgcaatatttattcttagaaaaaagacaattgttccatactttttctctcttctctctcatcaaaaacaccaaaaagtagatctaagtttttcttttcttttctcttcttagatcttaaaagctgaagattttccagatttcgattcagtttttcctttaatttcataaagttgaaattttcatatattttttctgggtttcttcttctcttattgtatccatcatagtcttagtcaaattccgtctctttacaaattttagattcgtccacaaagtgtttgttgaaattcctcagagagagagagagagagttgaattaaagaacccaaacatatattcttactataaatttgtaacttaaaggtagtttttgtgcgattttcattaaaacacattagcaaataatgataaaatggaagaaatacgaaaaatcataagcagagtgataggcgactagggtttcaagaaaaggatgatctataagcaaattactatttttcccttctcatttgtatgcaaattactattatgcaaacaacgtggtcagagttaggtggatgtgcatggatggtcgataattccaaatgattgaaatgaccacatggtcagagtttggtggatgtgtgttgacggtcattaattcaggaacatatttagggttttcacaaaagaggctagaacaaaggaataaaagaggaatattcattaggtaaagggatggggtctatttatagcaaatactaggttgccctaattcgctagaagacaaaatagagaggcggtttggtcgagcaggtgcaaatcttcaagactcaattttcttcacttgctcgacatacaagtcaagtataaaggccgagcacaacataaatcttcaaaatggctcctgctgcacattatgttgtaactgttgcactgctgaaacttctgatgcaccactcgaccttatcccgtgcgtagatctcgagcatagcttcatttctttgtgtggcatctctttggcttgaccactcgaccacatcccgagcattgaccccgagctcaacttcttaggtccaaaaactcccaaaataggtccatacccacctgttttacctgtaaatcactccatatgcaaatatgctatgcaatgcaatgcaaaacatgaaaaagaaggaaaatggactatgaatgcataaaaagagacgcgaaactacgttaaatgcatgaaaaacaagggcttaaactggtaaaatctagcgttatcaacacccccaaacttagctctttgcttgtcctcaagcaacaaatagaactaaggtaggagtgaggtttgaaggtggggattcagagccaaaatatgcatgtagagtaaatgggttcaatgtccatattgataagttgaatgatctttacttaaaaactttagccatcttcttcacaacacaacctaacttcttacttagtccattcaagcattcaaataagcatattccctttaacattcattaagtaagaaccatatatcacactatgcaatgtgtattgaactcatttggctaaggataaagggtcaagagacaaaaatggtcccttaaagaataggcttaactaacaagggatctttcaagaatgattaagttttagtaaaatgctaaaggtaagtcccaagttatgcatacagagataagatcccatctacccaaagtataacctatgaaactctagtggtaatcccatctcccgtcccaataagaacttaactctacccttttgcattcatgatcttttaaactctttttcagctcattattttctttttctcttaactctaggaaaagctttcttaactctttgatacttctagcgggtttggctttctttaacaactaagattctgtttttaatctcaattaagcttagggctttttacccttcttcattagctaacaataactcattcttttctttaacaatctcaaaccctttactagaccttttctaacttctttagcttacttctcctagaattctttttccttttcttataaacaatgaattcacctcattttctcttttaaactcatctcaaccatgatacaagcgcccacctagtcctatctagtccggataacgcgaactagaattacatgagacactatctctgtcgttacgaacctaacactttctaccaagcttaatcgaaataagacttcacaaaacactcacaactgatatatggcttgaaagaaggcttaggttagggtgtggggaaactgctctaaagatgagagtcagctaattggatcaacaagtgtggtgaaatgaataagaagatccaaatattttagggtaaccatgagatcaataagcaatgcatagtatgataattacaagtcagattagggttcaaattgatagggaatagcttcaaatcacaacaagtttcgactaaagaaaatcaagtatatgaattcaaaagatggttcagtcttacttctagttcactcgattaagcattagacaactaataacaagggcattgaatctatctagttaacattgcaaatttacaaggctatgatcatcattatcccctatgcaagtgcatgatgcaacaacctatatgaaaacacactaaaagcagctctaaaatgtaaatgcaaactatatgacactttatttttttggaatcatttttaaaaaaaaatcaaatttttatgggttttctataccttagatgatgcaaaaatttgaattagaaaacagaaaacaatgtcaaatacttcctgaactctcccgcaaagttaaattacacggtcctttatgtaataaaaatttgatggaaagttcaagagaaataacaagaaaatctaatatgcaatggtatttacaaaggttttggagttgatacctcatgttttaagtgattctagataactagtggaacagaggcggctatctcgagtgttgcactaagacattaatgtcttactcgacccttggtcgagttcgtgctctgactctttttaaaacctataaactgacacacttaaacagaaatatcaaaaataacaagaaaataagttatatgtacaaagatagacatgggacttcctcccaagtgagcttgttttaagtctctaagcttgactctcatactcattaggctcatgtggtttgttaaatggaaatgaggtcccctttggaatgatcttttcaactataaagcctgaatctttgtccattcattttgagttcagcttttgctttgctgaccaaggtggtggttccatcaggtggaatgtctttgatgctgaatggtacctggttggatttcccatggagctccttgagttgaaccttcaaccctctcatagtgtcatttagctctcttatggccttttccagtcatttagacttcttctgaagctctaaccaattatcagatgggaaagtgttttgctctacatgcatgtcgagcttagaggtcgagtgtgagcattttgaatgagtagagattgaacttgacctactggtcgagtttggtggtcgagcatgggttggacatgcctcttttgctgccataacctgtgtttttgactaaagcacacctttaatgacatctgtccatgctaccaccttgtttgaagcaaatgccttctttgagatcaaggtctcactaggaagagacttagcttcaactcccttagttaaagaagtttggagttgatattcaactgcaagctcttctaacttttctggaacactctccttctgtatagtagtattgcactcttcgctcttggttaaaggagtttggagttgatcttcaacaacaagctcttctagtttttctggaacactctccttgtgtaaaatagtattgcactcttgctcagcacaaccatttcctgaacttcttgggatctttctttcatcatctctttgtgatggtaagcatcaaccaagggtatctttgcttttaactctttgatgcacttgatgaacatcatcttgtgtttcttaaagatcctctcttcaatctgtgcaatccttcctggaaatggcagtttaagttcataaggaggtggaatagggattgggttactcgggtcatgtgctcgttcaacaagccgagcaaagaagtcgagctcaatttcttgagtcgtttttgcagttaaaacctccctttcttgatcctcactgtcctttgtgacaaaactatgaattgtggagatagcatgagcctactccttggggtattgagtagctttcgtagggagttggcttagatgttgtggtactgaagtagaggcaacttgcccttccattgtcctgagtttggaacctagtgattctatttgattttggagatcaacgaaagtagaatccatcttggtatgcatcttaaccaaatgcttttctaacactgtaacaccattgttctgagtttggactagttgctgaaacatagctgtgaagtcaggaacagctcgaggtggtgctggttgaggtggaggtgggataggtggttcaaattgttgtctctggctgaaaccttggttgaagctgttgttgaatggaacataaggtttggattgaggttgttgttgtaattgaggatatacgtgatcatgtggattggccacattgttgtttctgtatgagagattgaatgaggtggcttgtaactgttgtagccaccttgtatgtagctcacttcctcatatgggtaagtctctccttcttgaatctgttgttgctcttcatccgtaatgtagtgaatatgtctctcaacgattggtcgtggtagagcaatgaccaacttatcaatctttgcatgtagagcctggatatccctctgatgcatttcctccatctcagtgttgcctcaaattgaacgatcatactcatcacaatagttcccatcagattgagctaagttttctacaagttctcatcccgatgctacatctttgttgagaaaattgccattagaagcaatatctaatagcatccttatcttgggcaaagcttctctataaagtgtgctaagcagtgaagctttcttgaaaccatggtgagggcattgagtagtgtagcccttcaagcgttcccaagcttcagaaaatgattcagaatgcctctgtgtgaaacccgagatttcattcctcaatctagttgttcttgagttagcgaagaacttagctaggaatgcctttttacaatcagcccaagtgcctatagatgaagcaggcaaagtcttttcccaaagatgagctttatctctaagtgagaaagggaatatcctgagcttgaagctgtcctcactaactccattgatcttggttagactacataatcgatcaagactatcaaggtgatccaatgggtcctgcattgaaagtccatgaaacttgttcccttgaatcatagagataagaccacttttcatctcaaagttattgttctgaataggaggggggacaataccagctctctgatagtggtttctaggtgcatctccagaaccaatgttgcctggcaactcattaacattcgcctcattagccatcactattggatctgaagtggcttgttattctttgagttcacgctgaatcctgtcgatgtcgtctctataccgcaagagattatcagaaccttgagaacgagtttgcatacgttttgatgttgcgcggctgttatactcgacgtgctagtcgagtatgagtacctacaaaacaaaaacaagcaaatgaagaaagaagttagtaaccagaaagaagtaaatagaacttgaaatggatacaacagaaatattttgggtaaccgaaaatatccgaaatataattataatttcaaaaatattagttatttctaaactaaataattaaatatatatacaatagtaaaaatactcgaaagtaaccgaaaatatatgaaaataacaaaaataaccaaaatatctaaaaatattcatagaaaaataatcggatggatattaaattttaaaaaagcaaaagaaccaaaaccaaaccaaaccgaaccaaaatttcaaaataaccaaatggatactatactttataaccgaatgttagtgcattgtgatctctggttttgatgtgtgagtgtcttatgcatttgatccgtgttttcttgtcatgtctttgcaggtttactcgtgacacatcttcgaggctggttcgaaagattactagagtatggtcaaacaaatttgatggtgtcttctatagctggtcatgtgttcctcgggatcgacgagaaagatatttcctcgagtttgcggtatagtttttttctcttgcattcatttaaatgtttagctgtgaattatcttcactaacatcatgtctttgttatttgtagaaaacacaccattgggatcctttgataacaagaacagttcaatactattttgaaaatatatatcgccgacggatgaaagatatgattagcactgtgaggactagtcgagagtgtcctaaatggatcatcgattcccatatctgggaaacgatgtgtgcatattgggatactgaagaagtaattgcaaagagtctaacatattccaaggctcgcatgtctgaccgtaatgggttcggtcctcacatccatttatcagggccaacgtcgtatcaacaaatccaatcagaaatggtaaattaattcttgttctctctgttatttgttttacatagtccattgcaagtttagatgttgtcttagtccttgttcatttttagcattgtaggaagaggaattaggaaggacggtaggttttggtgaggtctttgtcaagacgcataccaaaccagatggcacttatgtcgataagaagacggagaagattgttccgaactatgagcagaaattgcaggagaagttgtctgaaatggaggcagagacttcaaatattttagacggggaatcatgacctcggcagctcacagcagatgactgtgctctcatcttcctataggtaaagtttacattttcataattatggtctgcatattctcatgctctttagtaattgtttgtctctttcttttcacagtctataaagacagattcacgaggaaattattatggagcgggcaaccttaaggagcatcttccggatctagtcactggaaaacgcaaacacttaggagaatcttcttctttcgtggcattgaaagtgcaactgaaggaagctcaacaaaaaattgaagagcaagctgcttataatgcaaaacgtgaggaagagcaaaccaaggctgtagctgagcagaaggacaagttggcacacttgtctttggttgagaagtatttgcgccaaagtgatccggcctttctccacttcatcgagtcttattcacctgaatcaactatagagcctatctcatctccaactacttcttaaggtacttctccctctttcaaaactagcatgaacttgtcaaaacttgttgtcttttgagaatttagtgtaatctgaatcttgtattttggttacaatataaatgaatttggtgtttgtttgaatcatgagtttggttttgaaatttagttaagaatttagagaaagcattacaagattaagcaatataaatcagaaatacaaaataacgtttttttcttttctctgaaaccgtagtcgttactcagtcacagattagtcgcagactaatccctacaataatcgaagtttatatagtttaatcgtaacttaatcgtaacatagtcgtaacatatagcgactattttacgactaatattacgactacgtgcattagtcataatttagtcgtaaattggcgactaaaattacgactattgagtttagcgactgtggatgtgcgacaacagtgattagtcgtaaaacagtcgtaatctatcgctttatgactactttgcgactaaaattaattttgcacaagaactaaacagaacgagcagaatactaaatccattagctaactaacaaacttaatcaagttatccctagacaatagattcaaaaccagatcaatccacttccatgacaatgatcttcataactttaccacttcctaatctagatttccattgatgaaacatagcaaagcaggctttaaacaccaatctattaaagtcaataagtagtctaaacatccaatgtcttgggctagaatctacaaatctctaaaattagttggttcagacatttcatcaaatacttgttagatggagaaagtctgaaatcaatttcaattgatcagaaagaaaatagtattgtgaactcctaaaacagaagggaatcatgcaaatataaacttagctagctaaagaaaagaggaattcacctaaacataacccatcctcaagaactcagaagaagactactctagaactatgaagaacatcatacaaaacccagaataatcatcaaacacagaaatcattataaacttagtatgcaatagatctaaggaagataaacaactttgtagaagaaaataattgcaaaaaattaaagattcaacaagaaattaaaggaacatatttagggttttcacaaaagaggctagaacaaaaggaataaaagaggaatatccattaggtgaagggatagggtctatttatagcaaatactaggttgccctaattcgctagaagacaaaatagagaggcggtttggtcgagcaggtgcaaatctttatgattcagtttttcttcacttgctcgacatgcaggtcgagtataaaggccgagcacaacacaaatcttcaaaatggctcctactgcacattttgttataattgttgcacagctgaaacttctgtgcgtagatctcgagcatagcttcatttctttgtttggcatctctttggcttgaccactcgaccacatcccgagcattgaccccgagctcaacttcttagttccaaaaactcccaaaataggtccaaaaccacatgttttacctgtaaatcactccatatgcaaacttgctaatgcattgcaaaacatgaaaaggaaggaaaatggactatgaatgcattaaaagagacatgaaactacgctaaatgcatgaaaaagggtttaaaatggttaaaatctagtgttatcagcatcgaaaccacatgctgatgtttctaattctgagattagcgatctgtggaaaggaggaccaaggtgtcagattttggattggtgtttagctgatgatgttatcattggtgaaggagagttttgctcagctgaacaatcatacaagattggacgcattccaattgatcgtaatgcagctgcgattttggttaagtcagttgtagatgtagaagcacctttgtggaggcctatgccaactgtttccacacttggccaatatgttgggacaaaaattgcatggcaatttgataagctcattttggacactgaattggactctccaacatataataagactgttgcttcatcggtaaaatattaaatattgtactgtaagtttttttttttcttagcttaatatgtcggtaactgatctattgttgtttttcttgggtttttataaacactccataggctgcagatgcagaagattatgagaacaatattcaagtggatgatatacaagcatacaaggataaaactttctcaaatagtagatcatttggggtaagactctaaagctcctctcttttaaattgattaaattgtctgaattgttgttgttatggacttgtgataaatttactggagatttcttatgtgtatgctgtttatttttctttggaatgtacttgtaatttgctgcctaaaattttcttttgtagagtgccaataacagctataacaacaacaacaccaacaacgagaaaaataagtgcatcctctaagattgcactggatctggaaaaaaaattgcagagggttgagttttctcaacaaatccagaagatagagttcattttgtccctttgggtctcaatgcaagcaaggtatgggtggatgttcctaccactgaaaatgcaccagcttggtgaccaaatgcagacattaaaatcattgttgatgctttggggaatacaatagcttggccaaatgacaaactcatttacatttgattctggtcttgtgtttctattatgtatgctttggggtgtacttcttcttcgactgaattaaacatgttatttggttttaacaacttcagctttatgaatatttttcttcatccaaaaaataggccacgacaattaaccaaacaaattgcaacatagctgaccatgtacaaacaatagcatatccattaatggcaaaactaaaaatgctacgataagaactaatttataatataaaaaccaaataattcataacttaaaaagacactattattaaacatacaattgcatataataaaacgctatagtaaagacaactacggtagcatatcgaaaaaccgctacaataggtcgtcggcctattgtcgtggttgatgatatagcgtttttaaatacgctatggtatcaattgacagcgttttttggatgctgtcattgcgtgattttcctgtagtgaggcaacaataagaaggtttaaagtttagggcttggggtttagggttgatggtatatggtatatggttaaaggcttagtgtctatggattaaagtttagggtttagagatttagggtttagggtttagggtttagggcttagggtttagggattagggatttatgctaaatatttgtaggcaacaataagaaggtttaaagtttagggtttagggtttagggtttatgatatatggtaaaatctatactttaggatttagtggtatagggtatatgtatatggttaagggctcagtgtctatgagttaaagtttagggtttaggtttgaatttaggagttagggtttaatgtttagagtttagtatctattgtttagggtttaggatttagtattaaggaactatgattgtttacaatgactttagagtttatgattacatggttctcattaaaattatatatttcattgttgtccatatggattagatcatctaggccacaattgttttgttgatttaggtgggtttttggattttggattttggattttggcttttggcttttgtttttgattttatgagtttttgattttggtggagattttagattttgcaaaatcttaaatggtaacttttctagtttttgatttttatataattattatttagaaacgttttaaaattatgtattgtaaactttatttttattttttaaaaacaaaaaaagagtttacgatagaatttgttgaaaatcccaaaaaagtgggttttggattttaagaacaaatgactagaatctataaaaatctagattccctataatttagggaattaattttttataaaatcataaatgggtgaaaaagtggattttgcaaaatcaaaagccaaaataacctttaaaaaccagtaccagtcaaggccctagattttttgttttctgaatctgtttatgtttacgtgatacaattaataataatacaaataaatatagtaatatggatttcaaaatgaaggaaaaatgttattattatatattttacaaaaaaatgattaaagatttttaataaaatagaaaatgtgacaaattaaagagaaattaaattaaaaaaaaagggagagagagaagaaagtgacaagagagataagaaagtgacaagagagtgaaaataatcatcatatctgttttattaattttaatttgactgtcaagatttaaagagacaatctgacggaccagatcattccgtcaaaaatatttcttaaccatgctacttgacttgaggtgaagagaataagggtataatggtattgatttttttggaatagtaaaaaaaaaacctcaaaaaagtgtctactccctccatgtgcctcatatgctcatagaaacttaaaaagtgtcctaagatacatttggatgtaaatatcctaacaaaatttgtaaatatcctaacaaaatttggatgtttaattaaatagattgagaaattttgtgagaatgacacataaacatgacattttcgttaatcacccataaggataaagttattttaagaaatgtttctcaattaatatataagggatattggcaaaaagactataattataattacaaaatctaacgacgtaaataaaaataataatctcaagaacaaatctatgggcctaggcccaaccaaaataaatgattaagggcctgcctgatttaaacacaacgtttgcggttatgaatgcgggagtttgctgaagcgggcggttgcggtttcaagcgttatgaaacattttgaaccactggtttaatggttaaaattgaagcgtttggaagagttttatgactggctaaccagcaggtgctactacggttaaattaaaaataaccaaaaaatataatatataattatacaaagtataaaaataccaaaaattatattattatgataaactgtaaaattgaaatataactaataataaaataaaattcttcttaattattcaaactaattaaattttgtactcaaatatgcatttggttcattaaaaaacatcatcaagttatatgcaaattacaaaaaaaaagaatatgacaaactaaaaaaaatatttcaatttttagatattccccggattaataatattattacaatacttagttagtatcttatcatttttcagtttggtttgatgctatgattttggtagaaaaaaactagcgttttaagaattaaaaatcaccaacatatatggaagttttcgagagaagtttacgctgaaaaatgttacagatgacattgttgatgtaatctgcaaagaagcaaaaaattgttacaactaagatgtcaattttttatttaaagtctaattaaatttatctctaaggtatgtttactctcaaatctctaatgatcaattcgattcttgtcactatttttttgttgttcaacgtgtatctatgatccatttttggtttaagagcttatttccgaactaaatgaagtcttagcagaaagaaacatcgaggaagaaggtcaatggaagaagaatcttaaagaagatacattaaagatttttgagttttttcctcaaaatattcaaggatcttatctaatttactaagcgtcattgtcgatcttaatcaataactactaactaggtcagtatccgtgctacgcacggtatctttgatttaatcaatcatcaaatataagttctgtgtattccacataaactctactttattttcattatatgtaaacatatagttgtatatcatgtatcattggaatcaaataaatatatttagtctcgtcaaacaatattttcttaagtatatttagttttctcgggttgtagcatggaaacaatgtctaagttggtatgtacgtttgggaacgtaattgtatattttgtatatgtaggtttacacatagtagctttgtacgttttcgtgtatgtaagtgttatagaagtttaacagaatctcataatcagaaaatttctaattatatatatgtttatatttacagaatgtgaaactaacatttgatgataaaataattatattatatgagacataagccatttgtgtaataaatagattttactaaattttgcaattctgatagagaccgacaaataaataaatattagaattagagatataaaacaataataagatgttaaaaaagaagcaataatacgtaatatttagtaacattattatttattttaggatgaatcatattaaattttgtcaataatagcgatgcgatattgtaagatatcaagttttagaaggtattctaaattcgaaatatgtaagagtcataaccaaaatcatacacaataaataacaagacgaccattaggccggtaccaaaaaataaaaatagaaacttgttcatacagaaataaaaataatataagaccgagttcaaaaagataaacacaaaaacattattttaagtagatgttcaaccgccattccttgcaccttcatcacgtagcctacaaaacaaacaaatgtggcatgcaattataaataatagtatagatatttcgtttatataattactaataacgaaatgtaagaatatatgaatagatcaaaacttacatctcatggatctcgttagactcgggaatatcaggatccggaaagacggttgatatcgggcctgcgctgcaaacacgtacgttctttggaccatcaaaataacggtcaatcttccaccacccaagaacagcgacaataactccaccaccatatcgatgataattatgatcaaagtcaagagcttccttcttagtagctagacattcaaaaacacggtttctaaacataaaatcaaaaatagtattagaatagtataatttaggtaattcgaattaaactatcaaagaaggaaacttactcattgtcacttattttgaatgttagcgtcaaatcatcgacgttgttttgcttaggtcttgtgttaatcaattctccaacatcatagatcgctcccaccaagtctccaacaaattacataaattaattaaaataaatcagagtcaaatatatacagttgatattgaaaatgacaaaactaatgaacactaagatgcatgatataaaataatgaccacaacaaattcataaaaatctcaccgactaaaacagatttatcgatttcatcatcaataatcgaagagaaggatgctagacgattgtgaagaatagcgggtaccagacttgttaatctaacgacagtgtcaacagaaaatccaattttgaaggtatgagttgttgccctgacagaacacgagttctcaacaactccaaaacttgttatcgttacccattctccttcattaataaaatgtttatagtgatccgacatcttatatccaacagtagtttcaatagtcataccctacggatcaaacatactaatcaaaattctaaaacatgcaaacctaaaattatcattacaaaacagtcaatacttacatgttcgtcggcaagaatcaaacccataacctttgaagatggaaccagcgaaactaagaatgtcctcacaactctcccacgaatacaccatcctgtaatagacggtttcaacagtgaaagaggatgaaacgattccatcttttggcagaaatttcttagttacttttttgtattcgttttatgagatgccaatgatagcgatatatatatatatatatataagagagacaaatacaccgtagaggcatgttttagacgcaattttttaaaaaagtaataatagtcatgacgtttcaagtcacttcgtaatcttgaagattctgtaatatattttgaataactcaattattaataaaattataaatttggcgagtcttatattttaggaaataatataaatattgtatcgttattattaattggatttgttatataaataccaattgttttaactgcgtggataaattactaataatcacatgatcctataatgtttgagacatataataacaaaatttccataaaagttaataattatgcagagaaataagtaacaaaattttaaaatatttttaataatagaagtgattactaattaggaaacaatatatatatgcaaatatattgttaacaacagaatctataatttaattatattatggcacttatatataagagttgaaataataaatgttttcaacttagaagattatctaacgatgttgattttaacgacatatttctttggacaaatcttctaataaactctaaggtttggtttttatttttctttgtttaatagtatagatatctaactcatattttagattacattgtaatcaaaatttgcaatccaaatacgtattattaaaatcaataaaatatcaacattatttaaaccaaaataaactaataattggctaatctaaaagcagttataatttgatctaagtttacagttatatagttatttaataagcattaaataaaaagaagcataataaagttaaagtttaacaaagtctttaaaagtacaactttaaaacataatagataagtttttaaacaaaacgatagataggggtctggtgttgcattttcagttctcgtccacaacttcacctagctcaggtgtttgcatccgttgaaggaattgagttctgaaacagtaggaaaatagaaaaattaaaaataaccaagaccaaaattttaaaaaatacaataaacagttaagggataataaaaatataaacgttcttacctgacgcgatccatgttaatttctgggtaactttgattgaatgtaattcttgaagcaccattatgtgagattagacattgacgacctaaaatattaatgtttttattatatgaagtagctatataaattatagataagataaaatgagtcttaaatataccttcatgatcatcaacattccaaaatcgtagcacacagattgtaggattcataccaaagttccaatgataaccaagttctataccaaattccctccataattgcacaaacaactcacaagtatatccgcttgcaacacatatcagagatttacccctaataacaatatcaaattattccaccaaacatctaagttctatgaattaaaccaactataaagataacaatatttactatgtttgtgcattcaaatatataaccaaatagatgacgaactatatagtggaaaatactaaccaagaatttttaatctcaaattcgagaaattgagaaagtataggattttctgaagcttgagggacaaagtccagtcttgttatattcccaactctgacgacaataccataagcatctacaaacaaaaaaaacgataatatgaaagattaatattttcaaaaaaatagactttatattagtgaaaaatctaaataagaaagttaccatggacagttgaagaatcaatagtcttgttttcgatcatagagaaggcaacaaatcggaaaaagttacttgattctctattaggcacaggagacattttggtagtctgaatgaacttgattctcaacttattatcggttaagggaggttttctaccgccgcctgatttgatcaaaggtatgttttccaagaaaccaacctccttcattgagaactgtagggacgtcatatccaatgtagaaataagcacaaatggcatcaatcattgtgccctaaaaaaaaaattgacttatgaattattaatagattagatccaaaaaacaaattaccatctcgtcgcacaagatcatttggtaacacttcccaccctcatgaggaagtgttatccaccaacatagtagcttcacaaaaacctttcaattttttttttttgagaaagttgaaatagatatgagatacctttaaaataaccacctctatcatctctcaacatctttttctttttgaaactaatagggtagaagaaagatgtcgaaggtaaataatggatgaaaataagagaggaggttacctttttttcaggttgtgtcctttgacagtttagaatattacttgtatattaaatagaaaaagttaaatgtcatgcaaatcttgtcaatcgaatttggaatctcgatggtaaattatagtgctttttatggttacttacgaaatttaataaattttgaaagaaccaaaatgtgacataagttgtcatatctcttggatgagttgactaatcttgttatcaatcttggaaaagatggaaagaaaagatgtgaacaatagatttaattgagaaagcaagtctcataaatagattgaagagaatatagatgttaatatttgtatctactcaataaaatctactttattactccagaaaatatgtatgagagcaaaatatatttagaataaactgatctatatatatatatatatattacattccttagaaattaaattctaactgttatatatgtatcgattatttttaagtcacaaaagtaatgatgtgactttcatctatatccaaaaagaaactttaaaaggagtacctaggttttcaaaatcaatattattttaatacgagagacaagatactgaaagataatgcttttgtagggttataaatataaagagtccaaatatttaagattactttttgtataggacaatgacattgagttgaaaagaaatgaacttaataataaatgatccttatgtttccaagaatgatttatctcaaagtttttaatgttttattcttgatacccaataattttaatttccttttaaaaagaatcataaataatgatatgtcaaataaaataaattaaaaggatagtattttaagagaaataaaaaaatactacaactatatttatatgtaatcgttgcaaatttatatatgagtttgtttgtagatttttatgtcatacttataaactttgttaggagtttaacaaaacataaaatatataaaaataaaaagggaatacaatacttaaataggttcaaaacataagcaaatttttttaaaaaaaataacttacaatgataaagtttgcaggaaatttaaataagttcgaaacataatttaaataagaataggagctgggaggtcaaactcctaattatcttcaatcactttcatccttgggttctctggaagttcatcataatcttcgaaaccgcggctgtaaaagagaaaaaaaaaaaattgtattgattaattgatgttatggttaaccaatacaataaaaaaatgataaaattcttacatgtagctttgaatatctatctcagggaaattggttggattgaggtaaattcttgaacatccaaattctctcttcaaaacattctcacctgttccattagtttcatttaaaattatataatacaaataacaatcataagtaaatagaattacaatagaaacaaaaataactaaccctcaatctcagctattctccaaaatctcacaatggcaacaatgggctgatagttataagccgctgaactaatacattttgagaaatttgtaacaaaaagttcacagtatcttccaacagcatagcatttcattttctctcccctaaccaatatgataaaatattagactaagcaatgcattattaagctaatttttcagacagatgacacattactaaacatacttaaaaacactacaacttacatattgtccaaaagttcgaatgagacatatcttgattcatagtcggtttcaccttggcgacaaacaaatagaaatttcttaatagccgagatatttgtcaccacacccattgcatctaagtatagaatactatattaataccatattcaaaaaataataacataaactactatcaaaaattaattcttaaaatgagaagaacatagattgactaaaaacttacccgtgacataatcccaatcctcaagacatggatacttaaggtcaatgggaaaaatgaagtcaaagaagtctcttttcacaagttccggaagagggtaaacacttgtttcccaaatgaatttgatgtggaatcgaaaggaagaatacctaacccttgattgaggaacaacgacccgaaagccagagatgtgaatccatgtgccaggcttgagaaacggacggaagggattgtgatagtttccttgaggaattgttgcatcaacacggttattctgaaaaaagtccaaataactcaaagattaaatagtttgtgatgatctgtttcaataataacaaagtaaactgggattaaaagaaaaaaaaagtgaaaatacaaaccttgtcatcatgaagaatcatggtcgtaatttcaccatgactatttggaggatgattccaaattgataggatcttcacgttaatcttccagttagttgaggtatccctcaaatcggtgagtttgtgaacagacattatgtgtatccaaggaagttttttttttgtttagaaagataaagagttaaacctaatttttttagacttgaggtttttgattttatataattggggaaagatacaatgatgaaaagttgaagtgtaaaaaggaaacgaatcgtctagaaccaataggatttcttataggttagaacaataatgatgacatttatttcttagcgtgttactaaatattataattaataaaatgagaatctatgaaaaaataggaataggttattttgtttgagttatcatgattaatcatatttaataagacggattatttagtgtacaaaatctttgctaattctgattttgtagaatatttaacacaaaattagcaaaattgtttattgttcttagtatgattaacattataaaaaccaaatcatgtgtttcttaataataaacaattttcttttctgaaaatttgatgttttgagtttttttcttctttcatcaagattgatgttctacatcaacatcattactatttttattgttaaccaataaaagaagagagaaatataactaatattatagttaaactaacaaaataataatatttcatgaaaagttgttattcttactttgtgtaaaaattctacaacataaaatttggtgaaaataagagagtaatcaaatctcagctctgtgtattcaaaaaatttagatttaacaaaacaaaacgacatataattgaaataactttattaattcccaaaaaaattccacaaataaaataaagatattttagatcttaaaaagtaaaataactctgataactttaagcaaataaataagaaagaagaaaacgatcaaagctggagtagtcattgagcatcattcgccggagccttcctcagacatggtcatcctagaacacttcttcctacttgtggaagcctgatcatttccatcaacatcatctgaatcttttcgttttgatgatggagtagaggttgacgacaaatcgacatcaaaaaggtcaacaccattagtgagcataagggaactctatatgaaaatacaaaaacattttaataagacaaccctaaaaaataaatataaataattggaatagtttaatgttatttgacaaacctgttcgatcgaaattaaggatgatggatcaacgtatgcatcagagtcttcttgaacgatttcatcaacaatgttaccggtgtagactcgggcaacagtgaatgaatcatatccaccaaatatgttttccctttgaatgcaaaatagaaactgaaaagtcttccctttcaaaccattgatcacatcaggcaaaacagttgggtcttcgatctacagaaaatatagattattataacatgaacgtggtcattttaatgaaagagtttatttttaaaaaggcattatacctcatcaaatgacccatcaagcaattcaggggcaatagtgccaaaaatttcctttgcatgactgtcgaataacatgcatctagcttcaccggtttggcccataatatggagatgtaaccaaaacctaaaagttaaataggattattagcttctaaacaccaaattataattaataatacattcaatataaagatttcataaagattaacttggcaacaacatattttgcaaaaccattgcatatttcacaccaaaatcttggcttttgaggtagcttgacatcttcaagtttgatagcttcctcttcgacaaccttcttgttgtgagcacgacaacaaaaatagtaccacggccaatctgtatcaattgccgaaacagtgcaaactgttttgcacttacccaccttcaaattaatataaagaggaattaacaaactaagttaaaaatataaaaaggtaataaaaaggtttgtaggaaaaataaattaatgaatagtacatcagaagatgtgaggacgtccttgattgtttgccttggataatcaccatcgtcatccccagttcttggtgcatagagcctcttgtgaaaagatccagaacttcccaaagttaacccatcagttggtatgctatatatcaagaaaatatacattgcttaatattatgtagaaacaaatatatttagtgacaaataaatacaattacctttgcttaaaaagacccaactcagccaacgtgggatccacgaagacttgtgaaacatcaaaagaattggaaacactcttagtatctgttttaaaaatataaggtcgtgtttttaaatagtatagatatgtagtaacacataacaatataattaccgttgtagagattgatcttcgcaaatcggattaagcaaacaacagtaccatcggctgactcctggcaagcttggtcaacaatctcagcatactttccccaaagtgtacatgccaagcgagtgtcactaaaaatggaaagaataaatttattaataaaaagtaaaaaaacaacaaactttaaataagaatgaatatgaatatagattgtttgtactgctgatctctcaaatggaaatcgatttttttggtgggcttgttgttagcgttaagatcttggattttagaccgatcgacaacctgacccataacatctgtatagacaaatagaataaatctatgaatataatgactatataagagataatgcatgtatgttcgaaaataaaatgaaaacttgaatctaactgtgcaagatatttgagttagcggatccagagaggatcacatcaaacttagcaagtgagaggaacaaagcatcagaaacggtatcacatggagagaccgtggttttgaaaacaaaaccaatcttgtttcaagtcaaaaatacgatactggccacttgtaagatttagagtgattgtcgtaataatcttccaaacaccctcgattaagcacctttcaaacttcttgatatgctctcttctcacagcagcatacatcttatcaccatatatgacaaaataatttaaataataattagtaaatgaaaatgatgcttgaacacactattaaggattacgaaaatataaagtagaaactataatacgtacaccttaatcaaccaaaactatttcgatggattcaccagcctttacagaatattgcctccaaacatgaagcaatttaacctgaatacgccaagcgttcttgtaaggttttagcgatttcaagggagtgaatggaagaggattggcgagcatcattttaaaaaatgaatttggaaatgaaactgtgtgagtgtaagctgagtgagtagattgaaatgaggcgtccgatatttataagaatgagcagtttggtcaaaaaaacatgcgcaaaagatattatccttggaattcaagtttattcgatataaaaaatccgatgattataggaaaatatttatcatttccataaaagtaggtatgaatatagggaatacttgaaaaaaatgtaagataagtgcaaaagagaattgaaacgaaatattagatatgttagaattatggagaaatgtaaaataattccaaaagaagatcgcaaagaaatattagatgtgctataattatggagaaaatgtaagataattcaaaaagaagatccaaacgaaatattatatgtgctataattatggagaaaatgtaagataattctcaaagaagatccatacgaaatactgtttcatcgtcatccacgaagatacgccaaatatttaatgaaattaatacgattagtttcctgaaatagagtcggatgaatttatgcatgaaactacaaaatcggacgacttgaaataaatctattcaacggccaggattaaaaggagaattccattttttgttttattaataaaaaatgcacgtgtatttttttggaaaatacgaaatcgaacggataaaaacaattcaattgaatgaccaagattataacgcataacccaaaagttgtaaaccagggtcaaaaagatccgcgtgttttttaagtgaaggcgagagatcgaacggacacaaacacttcaatcgaatggccaagattataacgtatgacccaaaaattgtaaatccgggtcaaaaggatccgcgtgttttttaagtgaaggcgagagatcgaacagacacaaataattcaatcgaatggccaagattataacgtaagttaagtgattctcagttaaaggtaaatttttccatgacattaacattttaaacatatgattttaaggtaatttttttgttttaactgagaatcacttaacgtacgtctcaaataatagtgtagatcatttgagtacgttctatacttctatgaaaaagattgattatccatgtcatcaatccacgtcattacacataatccacgtcatctgaaaccgcataaacctttcggtttcctcccgaacagtactgttcatcagcggaaaaaaaaaactgtcgctctctctctcgacgggaaaacgatatctaaccctaatttcgccgccgttttctctatctctcgtctgtttcgtctgaaactctaacagcggtgtcgcattgcaagttgagtaaagtcacatccctatcaattcgcatatgaactcaatttgtctaagttccggtaagtctataacctaactttacttcaaattttccgacaagaatctgacatctaagttcaatagcaagtgattcccgtcactgaaaccgtttttcgaaaactatcgcgatgttattgatggtttttaacgatgcttattccggctggtttttgccgtcgttgattgacatatggtgtctgatttgttatatctatttgatttgatggctgagttactatttgtttgccgactgatttataatttatcaatgcatctgtgtctgagtttgttatatgatgtggttgagttatgattttatcaatgcatatgtggctgagtttgttatatgatgtggttgagttatggtttatcaatgcattcgtggctgagtttgttttacgttttgtctgagttatggtttaaccttacatccgtggccgagtttctgttatgatgtggttgagtttgttttatgtttgggctgagtttctgttatgttatggctgagtttggtttatggtttggctgagttatgttatctgtggctgagttgttttatgttgtggctgagtttgttttacgttttatctaagttatggtttaaccttacatccgtggccgagtatctgttatgatgtggctgagtttgttttatgttttggctgagtttttgttatcctatggctgagtttggtttatggtttggctgagttatgttatctgtggctgagttgttttatgttgttgctgagttaatttatgcttacggctgatttatggtttatcagatgtctgaagaccaagcaagggattaccgtccaagactttacctagcgggggattctaatctagaggctaaagccattaatcagaacatcaagatgggagatttccctctgattagagaatcaataggacaagatacatgagatcaaatgaaagagacacctcttggattaattgctaagctagttaatagccattttctttggtctggtaagattatacattatctactctacagacagttaagaatactgaaaaaggagatttgttgtctcgtggctggtcaacctatcaggtttggcttgaatgaatttggtcatatcacgcagtttaacacagatccactaccgagagaacagtttaagcatgcagtggactacaaaacgttcttcagggaattgggtgtgccaaccggtgaaggtcttaagttagatgaacataggcgaggcttagtagtgtgcagagcatggcctcttgaaaagcgtatatggtttggcttgcatcctaactctaggataccatttgagagtgccaaaagagtttttgatgacgaaaccatgaagacttatccatggggtcggtcagcatttgaaacccttgttgtttctataaagttgccgaggcctattggcaagtcgtacaccatcagtggtatggctttcgtgttacaagcttgggtgtatgattcaatcaacaccattggagagcgatttgggaacgtagtcaaagaggatgagatttcgttgcttagatggggttgcaatcgtacccgtacaataatagaatcggccattgctgaagatatcacaaacataacgactactgcaagtgcacaatatatatgagtagtactttaggatcgaatccacaaggagagaagtagttcaaagaaatccttcagaagagagtgaagctaggaccaaacaaaaagagagggggttgttgtatgcagtgaataagcaaaataaaagacaagtaactaaaatagacgataagcaataagagagaagtgttaggtctttgggggtttctccggatatcatggttcaaaataaaggtatagatcccaatttaggtgataatatggttagtttttttacttcccaattctcgttaggtgaaagccggctattctcactatacctcgccactcagttgcccacacggctaggaggtgctaacatagtttcgagatacagatgaaagcattaagttcaagtttgattctagtccataagtccctatcacttggcgggtgagcaacgattatagttctttattcagttgagatagttcaagcaattatacaagattttgccaagtataaaatacctaagatcaagtacaagttggcgtttcagacatacctgcattaagattaaattcaactagaaagaatagtgtaaacgatcaagcaaaaccatagaaaccaccaacctaaatcagatctaaagtccccatgaattcccctttgaaaccccctcaaacccaactagagatctactcgctcatggcaaaggagctaatcaaaagttgggttgagtaagtcataataaaaagacaaataaaacttaaaaggggttcagagattacttctttgaatgtagaacacaagaggcaaagctccaccttaaagaatcttatacaaaacgaaagagaagaagagggagatggtgatcttcgagctcaagaggtacggtggcgagttggcagctctcggcgacggctaggttttgcttgtgatgaaggcacacctagggttagtaatgtagggaaatatacgattgaaagctcttgtatcaatggatcaagagtattcgttcgtagctcggatctttagctttcttaagtatctatggatcaaaagaaagaagaactcaaagacttcagatgagaaaagcttctcttttataaaacgaaaacaaccaagttataagcttacaagaataagagtatttatactctcctaaaaacgaaaaccctaaatgatgaaagcttgtcgactaagcaacactaaaccgtcattcaaaataaagaaagcccaacaagagtattatgaaaacttaaaaggaaaaacccaataaagagatagatggatgatgacgctacatcaggtcacccggggtagaaagaaaatttgttctcgaatattcagcttcctcactagcgacataaggaaccagatgtttcacattgaagacgtctgcggtctgcatatgtggcggcaattgaaggcgatacgcattgttgttaatcttctcaagaacttgaagtggaccaatctttcttgacttcagcttattgtacgttcccggtttaaaacgatctttggtcagcaccgcccaaactaagtctcccacattaaacgtaacatcccgacgatgagcatcatcagctttcttgtacttctccgttgcaatttcaagattggaatggaccttttcatgaacagctgcaaaatcatcaacaaaatcacaggctctaccatgaaagcgagtacgatctggagagataccaagatctgcagggcagcgaggtaacaaaccatagaccacttgaaatggactaaacccggtactccgattagagctctattgtgagcaaactctgcctggcaaataaccgtatcccaagatttgatattatcaccaaccaaacatctcaaccaaatcacccaaagctcgatttgtcacttcggtttggccatcggtttgaggatgataagccgaactcatgtccaatttcgtacgtagcagccgccacaaagatctccaaaaatgacttagaaaacgagagtcacaatccgatacaatagacataggtaaaccatgaagtttatatacttcccgaaagaacaaaatcgcaacttgtaccgcatcggtggtcttcttacacggaataaaatgcaccatcttggaaaaatgatcgacaacaacaaagatggaatcattacctcgttgtgtttgtggtagtccaagtacaaaatccatgctaatgtcagtccatggctgtgttggaatcggaagaggcaagtataggccagcattagaagctttacctttagcagtttgacaaacaccacaacgaacaatgaatctttcaacatcacgtcttaaggttggccaaaaatacgatgagcttatcaattgaagtgtgccatctcttccaacatgaccttctccatgaagctcgctaattaacttcaacctcaagctacaatcaggaatacatagccgagaaccccaaaacaaaaatccatcataaatgagatactcatcaccaatcccattggtcgcgtcattccaaatcttagcgaaaaaacatcagtaggataaaatgtaggaaggacttcaaaacccgtaattgacatatgaaatgtcgtcaagagagaatgtcttcggcttgaagcatcggctaccttgttcaaagtaccagctttatgtttaatcacaaaggagaattgttgcaaatatgcaaaccaggaagcatgtctcgccgaaaccttgtcttgagaacccatatgtttaagagcatcatgatctgtataaagaacaaactcacgatgaaaaagataatgccgccaatgttttatggattgaaccacgacatataattcaacatcataagtgctgtaacgaccccttgctccagctatcttctcactaaaaaatgcaacaggtcgacccaattgactcaatacgccaccaatacctgattttgaagcgtcgcaatggagttcaaatgcaacgtcaaaacaaggaagaacgagaaccggagctgttgttaactttttcttaatcatgtgaaatgcagaatcaacttcttgtgtccatgaaaactttgtagctttcatacaatttgtaataggcgccatgatgctactaaaatgcgagacaaaacgccggtaaaaatttgtacctgattgtggagttggccaagactcgatggtacttacctttgccgagtccactttcaatccatgtctcgacactatattcgccaaaaacagaacttcctccacaccaaacgaacacttctgcacagccccaaataatttctctcgtcgcagcaccaagagtacctcacgtaagtgactaaggtggtcttcaagggacaaactgaaattcaatatatcatcaaagacaactacaaaacgaccaatgaacgggcgtaagcttgattcataacacgcataaatgtgcttggcgcattagagagaccaaacgacatcacaagccattcaaacaaaccttctcttgttttaaacgccgttttccactcatcactaggacgtatacggatttgatgatatccactcttaagatccagcttggaaaatatcgtagcagagccaatttgatccaaaaggtcatccaaacgcggaattggaaatcaatagcgaattgtaattttattgatcgctctactatcgacacacatacaccaagaaccatccttcttaggaattagcaatgcgggaacagcgcaaggacttaagctttcacggacatgccctttagaaagaagttcttctacttgccttcgtaattcatcttgttccataggactcatgcgatagtgtggtcgattaggcaaaattgcactcgaagccaagtctatacaatgttgaatatcacgtaatggaggcaattcattaagtaactcttcaggaaaaacatcttgaaattctgctaacaattcacgaaatgcgtctcgtaccgcagcgacaggtgaagacatgtaaaaactctataaattaataatgtcgggaccggaaaaatttgttaatttaaagaggtattaatttatcgataaattaataattattaattgatagagatattttacaaatttttgtaatttcttacaaaatttgatttaaaaaataggtttttctatataatcaataatctttttaaaatcaattacaagtataaaaccattattaggtttaaaacaaaataaactttttgtacttggtaaaaatattagatcggaactctacaaaaaattaatttaaattgtataaaagaaatactagagtcatattttactaaatttttacataatatatattcataaatataaatatatatattcataaatttatacaattattaatttataatattgatgggaccatatatttacataagattttcaaaaaaagttactatcttattaatttatcaatttgtatcaatttttacactggtcccaactcggaatcggaagaatttattaatttatagaaattattaatttatctagtattaatttatagagactgtacttgtttccatcattagcacaaatgctacttcctcctcttgaagttcttcgaacagttgagacttatttattaagagtacaggtttcgtctcttccaaagacacagatttcttctcaatatcttgacttgtaaccaatggctcagaacacttttgagattgcaataacgtaaggcgttttccttcgtatgaaaaactatgtgtgtttgtgatatgtctataatttgcatgatttaggcattcattcttcaccactttgtcattgtttcatccataaatcatctcattaggagtcgttttagtgtgttttacatacttaggacgattttgcattaggattgcatgtgcatggcatatttggttgttttcaggtattttggatgcttttggagttcaaacagaggaaaaacagaatatgaagtcggaatgcccaatgacgccttcagcaaaagtactctatcgcagcctcggagccctgccagggcaaatcactctatcgcaaccccggagaagcaagcagctcagtttcactcaatcgcgaagccggaggaatcaccccatcagaaccactcgatcaccactcgaccaccaagaagcctatctgctctttctgcactcaaccagacaagctgagaacaaagaatagaagagaagccgaagaagccactcgatcaccacctcatgacatccactcgatcgcactcgatcacaggatcgctggaccattcaatctcgacttcactgcatcttagtcgattgcaagacggagcccctaaagcccagtttgatcaatgacatactcgatcactaggaagctcatttcagcccgtcagatgccaatgacatattcggtcgcaggatcatgacgtgaagattcgctatatatttagtttccttatttgtttcatttctcgcttatataaactgcctcttagggttttccctagggcatccgttattatctcgcttttacattttcgcaactttcatagccgcaatgtttctcctgcgactttgtattttcactttcaagtatttgatattaagttttcgtttaagtctttcgtcatttctgttatcatgttttcaatcgttgctttgctattgtctttgattatgtctgagtagtgaactgtatttctgaggatgggatagaatagttgtggtttacttggtcgttttaggttgttgagtttagaatactagaatcccttctggattagttgcgcttattgcttgtttcactggctaatgtggagtatgagtccagacgtccagcgctcataaggcgtttaagcgttgaatcctattaattccagagatatctgactctaccccaagggattggctgtagagagggtattgactttaacatgttgattcgataatgcctgcttagttagagatcgctaaagggatttaggtcagtgtctagctttgcttgaggatttctatcacgggagtgaattaatctgttgttgaacttgttgtctagggatagcttctgtgaagttttctcaaccgcctgaatagattaagtagaccacactattcgattatcccatccttaggaatcgtttatccatttgattgcctgttatcatttctgctttgtcattcacttgcctgctattgccatttctgcttttagtttcatttcatttctgttattgcatactaggaatgttagaaccaaccaactttcttcttggcttgacttagagttttctgatcatatctcatctgtttgcatcacaccggattggattgacatcctaaaatagtacaacgacaagatagtgttttagggattaattgagtaaaatcctactatcaatttggcgccgtagccaatttagggtttgtttgctatatttgagatcattagaaacgttaagatcaagttcgtttttgttacacaagttactaacattgtgccttttctgtctttgtgtttcaggtaccttgcaacctgctttacagaagtatctctgattcgtctattatatcccggctgctatctgttgcatgcatacacggtcacaaggaaatctgaacctcctattcaacgataacatcgacagtattgctcgccaacaaagagaacacacagaaaccgacacaatggctgacgttgtagatgagcaagagcaacctaccaacattggtgctggtgacttccctcacaaccacaaccagcgtcatggaattgttccacctccagtacagaataataactttgagatcaaaagcggtctcattgccatggttcaggggaacaagtttcatggcctaccaatggaggatccgctagatcatcttgacaagtttgaaaggctctgtggccatactaaaatcaatggagttagtgaagatggtttcaagcttcgcttgtttccattttcacttggagataaagcctatatgtgggaaaagacgctaccccagggatcaatcacgacctgggatgactgcaaaaaggccttcttggcaaaattattctcgaactccaggactgcaagactccagaacgagatatccggattcactcagaagcaaaacgaaagcttctgtgaagcttgggagcgctttaagggttatcaaaccaaatgccctcatcacggatttaaggaaacttctcttctcagacactttacagaggcgtcctacctaagatacgtatgctccttgacaccgcctccaacgggaatttcttgaacaaggatatcgaagacggatgggagctagttgaaaactaggctcagtcagatggcaattacaacgaggattatgacaaaagcatccacaccagtactgaatctgatgacaagcaccgccgagagattaaagctctccatgacaaaatcgacaaactcctccaagtgcagcagaagcatgttcacttcgcctctgaagacgaagtattcgaaattcaagagggggagaatgatcagagcgctaaaatcaattatgttcagaaccaaggcggctacaacaaagggtacaacaattacagacccaacccaaatctgtcatacagaagcacaaatgtcgccaatcctcaggaccaagtttaccctcaacagtagcagcaaaaccaacccaaaccgtttgttacttacaaccacagccaagggttcgttcctaagaagcagttccaaggagggtatcaactacaacagccaccacctggtttcacaccacaacaacatcaggcctctgcaccccaggaatcagacatcaagaatatgctccaacagatcatgcaaggccaagccgcaggggtaatggaatccgcaaagaagctggctgacttaaacaacaaatttgacagacagttcaatgaactgagtagcaggttggaatcattgaacacaagggtacgatatctggacggcattactacttccccacctgttacaaacaacccatgccagcttccaggaaaagcaatccagaaccctaaggagtatgccactgcacacgcaatcactatcagacatgagcgagagctgccaactcgacatgtctctacatcaaacactgaggacagtgtaattcaagaaggggacgcttccactcagattgaagtctctgttgctgagatcggctattcagctcaacctttctatcaggctcagtctgacttggaggagaaggctgctataatcgagaggatggtaaaacgattaaagccagatccatcaccctcacttgctcttccatggacgttcaggaaagcttggaaaagtagatatgaatctctggcagaaaaacaacttgatgagatggaagctgtgatgcccttagtagaagtcctcaagttgatttcagaccctcacaaagatgtgagaaacctgatactggaaaggctcaacatatatcaggattcagatgacgaagacgatgtcattatgcatcaagccgctggtgagaggattattcaagagaagctggaagatcctggatctttcactctgccatgttccattaggcaattgactttcagcaattggctatgtgatctaggagcctcagtcagtttaatgccactctttgtggcaaggaagctgggattcgttcagtacaagccctgtgacatcaccttgatccttgctaatagaacttcaaggagacctttcagcattctagagaacgtgccagtaatggtagatggagttgaggtacccattgattttgtcgtgcttgaaatggatgaagagtctaaggatcctctaatcttaggaagacctttcttagcctcagtgggagcagtaatagatgtcagatatggtaagattgatctcaaccttgggaggcatgtcaagttacagtttgacatcaacaaatttccgacaaggtcaccaacataaggaaaaaccttagagatccagagagcggttccaagtgaaggctttgagatcaaaagagggaaagagcaaatttcggttcaaactccgccatcgaactcgactactcgatcgagtataccctcctcacttgattggctggaactcaaaaggaagactgatttccagaacagaaccattaagaagctgagctacactgttgaaaagcttagagacaaactaagtcgaatgcaaaaggaggttcaaccccagctcaaacatgacaagatttcaagaaaggagatcacctgggattggttagaagaggaagactatcctccagaggaggaagcagcctactatgaggaaagaagaattgaatactcagctgtgcaactgtcaagggaggatgctgagtatgatgatgatatcagtgaagaggaggacttctcaagctccctctgtcacattttctccacttgattagtgtgaggagtcaagctagagactctaaacaagctcacttgggaggaagtcccacgactatccctgtatatactttttatttatttgttacttttgattcgttttggttgtgtctttgattctcaggaaatgaataacagctggagtgatcaacaaggatgtgatcgagtgttaaaatgaaaattttacaaaaaaaatttcaaatactcgatcacaacataggagtgaaagctcaggagtacgatctagcagtttcgagataacaattttctactagatcgcaaggaggagtgaaagtgtccacagaacgtcaatgacaaacctcagtcccattaagtctactggatttcaacctccaccaaaactccaaaaagcccatgctgtgtccacttgtagcccatgacacggaattaaaggatcaacagcccatactcgatcacaaggcgcgtgacttgaaggaccccatcctgccgacataaagcaccatgctttgtcaccttatcactttgctgacatcataacgggcatttcatcccatccgtctgtttaaaagcaacacacctcttccactcattcaaatcggaaagggagataagtgtcactacccttcacttttcttcatcacttgtgatttcaaaacatctctcttgtttatctctctacttcactaccaaaaacgctctcaactctttcgttgttgctagctgttattgattagaacagaacctcagaaactactctatcgcaaccctgtctctcatttgcttgcttcactcgatcgcgacctgagctctcactatcaaattctactcgatcgcaactctatatcaataggaagtcatttctttcattgtctttgtttgtttctcactaacctactgagctttagttgtgagtttcaaatcgatttcagcttcaagatgagttcacacagctacgaatcatctatggatgccgactactatgttgatgatgctgaatcttggtcaactaggcccgagagagaagcagaggagtataggcgatttgtggaggaaacagagcgagcaatcgccaatgacaggagaagagaagcgatagccagagggaagaggtcaatgacggaaaattatgagctaattgatgaagagatggaagatgatgcggagtacattccggagcaaacccgcaagaccaccaagtccctaatgaaagaagacaagctgaccccgggagactactacaaggctctcaaaagaaattcgttttggggaacaagatatcctcacccggagacaatgatggagttacgcatcctggaagacgttcagctcttgttcgagaaatgccacatgacaacactcatgtctcatccctatcctacctatgaggatgagacacttcaattcctttcatcacttcaagtggaattatttgaggggttgtcagctagtgagttaagagaagaagggcttggttacttaagcttcaccaacgacgaccgcgactatatcatggtgatcaagacgctagaatccatgttcgggtttcccaatggcacgggaacgaaaccgaggtttgcccgagaagagttaaaatctttgtggaacacgattggagataccaccagcttcaactccgctagatccaagagcaactccatccgcaatcccgccattcgctatttccagagagccatggccaatgtcccttacgctagggaaatatccgctactgtgacgaaccaagacatggagacgttagacgtggcgctgctaagtttcctccgttacaccaaggacgggaaaacgatgaagggagataccaatgacacacctccgtcaatgtatcttctcaatcacttatgcagctacagagggtgggcgatggccaatgacaagaagaacgcgaaaggagccctttgccttggaggagtggtcacaccaatcctcctatcgtgcgacgtcccgctgcgaccggatccaatccaaccacgttggatggatatcgcccatctcaagcttgcccatgtgatcgagcataaggtctatgacaggaggtactctttcaagtttgatcacccgtcaacaggcgaagcaactattcttctcccattcagtgaaatgacaaccaccacggtgagagacaacatcgacttctcgccaccacaagaaatcctccatgttgtgattggaggatccgcgtcccggaatgttgaagaagtagaaggtcagagtgacaatgaggagaccaattgggagaactatgacacgagccgctaccactttgaagaacataagcccccttcacgagaaagcaagagtctcgctgaagcacatcggaagctcagtctaacccaaaggtgaggcaagtttcaagacaagatcatccataagtgtgtcaaggccattgacaacatgcagaaggcaatcagttgcaccacatccactagtgcgatcaccagagacaacccgctagaagacatgccatccaggcgtcatgacattgccccgccaaggcaatctgcttatcaacagagagaacgcgctgtcccgcaagaacccgcacgacactcgtcttacgaggtcagggagcacaagaggcggaagagcgctaggatggtccgatcatcaagcaagagtcggataatgtcggatcagagaacacatgagcgtcgtgctccacaacctgttggggttgcgatcgagcacaatgacgaggagatggcggagccacaccaagaaccggtcatgcctgctgagtacgctcaagcagatatggatgactacatctccaggacattctactgaggtaacacaccaaaaccctttgtaaataccgcttttgtttttgtttctgtgtttatcttgaattctttcacaaattttgattacacaagggactgtgtaatttaagtttgggggagggttcaagacgtatttgacttgttttttgtgaatatcatttgagtctgcatatcatctaagtcatagaaaaaaacaaaaaaaattttgaaattttttgaaaatgaattccacaaaaacagagtgatcatttagttgcattacatttagaatcgagtatagagtgtttcatataggattgttgcatatgcataggggataatgaggaaatagccttgtaagcatgatgattcactaaaatgagttattagttctttgaggcatttgaatgactttgaagtaaaaccgcaccatgttctatagaaaccactcgatgcatgtcatgacacctttccctgtcaatttgaacttgaatctgacttataattatcatgtttgcatcatttttgaactcgtggatagaatacatagttggattttctttcacttattcaccactcttattaatccaagtagctgcttctattattggagtagttcccccacccttaaccaacccttctttcaagccatgttattttatgagagcatgtgaggcctattttcaggattgagcttggtagaacgtgttaggtttgagccgacaagagtagtatctcatgtagttccaatccgcgttttcggacttggtaggaataggtgggaacttatttggggattgggattgagtgagaaaagaaaaaaaaatgaaaaaatgggttagagtctttaggagaaggaagctgaaaatcatattgtggtctaatgaatgtttgggaagcatagaattgttaagatatgctctaaaaaaaatagatggcaacaaaaacagaaaaagaaaaaaaatgataagagccataagagtttaagaaaaacccaattcactagactagactcatagagtttaagaaaagcttctccttaagaacaagagccaaagaaaagaaaaggaaatattgatccaagaaaaaatcgaaatatgcctttagtgcaaaagggtagacttaggatcatcattgggtttagagataggaccatctacttgttattcacggtttatgtcattgggtagatggggtgctattcttgtatgcatatgttggcacttacctttagcattcttctaaagctcagtcctttttcattgagagtccccagctattaaaatctgaaccactaaaaagggaccatctttgtctcataacctgtcattagccaaatgagttcactagcgatgcatatcttgattcatgtttttgaacttaatgaatgttaaagggattggttgatcttgacgcattatgcatttgagtgtaggtttggatcacaacagagcatggctaaagtttttaagtagaagtcgatcacctcgcatcttagaactgttagctgaaacattgatcttaattgtcatatctcatgctttggttctgaatctccaacttcaaacctctccttccgcttatgtcttcttgtttgcttgagggcaagtaaagactaagtttgggggagttgatatgtctataatatgcatgatttaggcattcattcttcaccactttgtcattgtttcatccacaaatcatctcattaggagtcgttttagtgtgttttacatacttaggacgattttgcattaggattgcatgtgcatggcatatttggttgttttcaggtactttggatgcttttggagttcaaacagaagaaaaacagaacatgaagtcggaatgcccaatgacgccttcagcaaaagtactctatcgcagcctcggaaccctgccagggcaaatcactctatcgcaaccccggagaagcaagcagctcagttttactcaatcgcaaagccggaggaatcaccccatcagaaccactcgatcaccactcgaccaccaagaagcctatctgctcgttctgcactcaaccagacaagttgagaacaaagaagagaagagaagccgaagaaaccactcgatcacaacctcatgacagccactcgatcgcactcgatcacagggtcgctggaccattcaatctcgacttcactgcatctcactcgatcgcaagacggagcccctaaagcccagtttgatcaatgacatactcgatcactaagaagctcatttcagcccgtcagatgccaatgacacattcggtcgcaggatcatgacgtgaagattcgctatatatttagtttccttatttgtttcatttctcgcttatataaactgcctcttagggttttctctagggcatccgttattatctcgcttttacatttccgcaactttcatagccgcagtgtttcctctgcgactttgtattttcactttcaagtatttgatattcagttttcgtttaagtctttcgtcatttctgttatcatgttttcaatcgttgctttgctattgtctttgattatgtcagagttgtgaacagtatttctgaggatgggatagaatagttgtggtttacttggtcgttttaggttgttgagtttagaatactagaatcccttctggattagttgcgcttattgcttgtttcactagctaatgtggagtatgagtccagacgtccaacgctcataaggcgtttaatgggcgttggatcctattaattccagagatatctgactttaccccaagggattggctgtagagagggtattgactttaacatgttgattcgataatgtctgcttagttagagatcggtaaagggatttaggtcagtgtctagctttgcttgaggatttctatcacggaagtgaattaatctgttgttgaacttgttgtctagggatagcttctgtgaagttttgtcaaccgcctgaatagattaagtagaccacactattcgattaccccatccttaggaatcgtttatccatttgattgcctgttatcatttctgctttgtcattcacttgcctgctattgccatttctgcttttagtttcatttcaattctgttattgcagactaggactgttagaaccaaccaactttctacttggcttgacttagagttttctgatcatatcttatctgtttgcatcacaccggattggattgacatcctaaaatactacaacgacaagatagtgttttagggattaattgagtaaaatcctactatcagtttgcaaagccatcatgcataattcgtcgatcatactgccaaggacgacctaatagcagatgataagcatccattggaagaacatcacatcacaccaaatctttataattcagaccaatagaaaacgggacacgacaacgcttcgagaaataagaatttgttgatgaattaagccaagctaagcgatatggtgttggatgagactccgtgaacaaggccaatttagtaactgcttcttgagaaatcacatttgtgcaactccctgaatctatgatcatgcgacaaactttacctcttatggtgcaagtggattgaaagatattcgttctcagccatgattcttctacaccacgcggtaagagatgattccaacgcaacattaacattggacctgaatccccatcaagttcctctgtaacttcctctgtttcatcttcttcttgttcatacacgtcgtataccggttcatctttagccataaggccacgacgagctggattaggacaagctgattgcctatgtccttggtctccacatttaaagcacttgaaattagctgatctctgctgtcccattgttgtggtattctctggaatttcagaaattcgcacttgatccaatggttggctagttcctgtgtccgttgctgacgaaagacgattgcgagatggattcgaagacgtgttctgatttctagcactttgttcaattaacaatgcacgttgatgagcttcagagagagttatggggttgaactgcagcaaggtgttttgaatctgagttcgcaaaccaccaatgaatctcgacaccaattgttcttcagtttatgtcaaagaa
